(12) United States Patent
Bensi et al.

(10) Patent No.: US 7,838,010 B2
(45) Date of Patent: Nov. 23, 2010

(54) **IMMUNOGENIC AND THERAPEUTIC COMPOSITIONS FOR *STREPTOCOCCUS PYOGENES***

(75) Inventors: Giuliano Bensi, Siena (IT); Guido Grandi, Siena (IT); Nathalie Norais, Serre di Rapolano (IT); Manuel J. Rodriguez Ortega, Cordova (IT)

(73) Assignee: Novartis Vaccines and Diagnostics S.R.L., Siena (IT)

( * ) Notice: Subject to any disclaimer, the term of this patent is extended or adjusted under 35 U.S.C. 154(b) by 124 days.

(21) Appl. No.: 11/792,038

(22) PCT Filed: Oct. 11, 2005

(86) PCT No.: PCT/US2005/036009

§ 371 (c)(1),
(2), (4) Date: Nov. 25, 2008

(87) PCT Pub. No.: WO2006/042027

PCT Pub. Date: Apr. 20, 2006

(65) Prior Publication Data

US 2009/0117113 A1    May 7, 2009

Related U.S. Application Data

(60) Provisional application No. 60/616,854, filed on Oct. 8, 2004, provisional application No. 60/652,736, filed on Feb. 15, 2005, provisional application No. 60/701,121, filed on Jul. 21, 2005, provisional application No. 60/705,209, filed on Aug. 4, 2005.

(51) Int. Cl.
*A61K 39/09*    (2006.01)
*C12P 21/04*    (2006.01)
*C07H 21/04*    (2006.01)
*C07K 14/00*    (2006.01)

(52) U.S. Cl. ............... 424/237.1; 424/184.1; 435/69.1; 435/69.7; 530/350; 536/23.1; 536/23.7

(58) Field of Classification Search ........................ None
See application file for complete search history.

(56) References Cited

U.S. PATENT DOCUMENTS

| | | | |
|---|---|---|---|
| 4,281,061 A * | 7/1981 | Zuk et al. ............ 435/7.9 |
| 4,454,121 A | 6/1984 | Beachey |
| 5,098,827 A | 3/1992 | Boyle et al. |
| 5,354,846 A | 10/1994 | Kehoe |
| 5,378,620 A | 1/1995 | Adams et al. |
| 5,391,712 A | 2/1995 | Adams |
| 5,445,820 A | 8/1995 | Seidel et al. |
| 5,585,098 A | 12/1996 | Coleman |
| 5,700,648 A | 12/1997 | Kehoe |
| 5,821,088 A | 10/1998 | Darzins et al. |
| 5,846,547 A | 12/1998 | Cleary |
| 5,968,763 A | 10/1999 | Fischetti et al. |
| 6,174,528 B1 | 1/2001 | Cooper et al. |
| 6,372,222 B1 | 4/2002 | Michon et al. |
| 6,406,883 B1 | 6/2002 | Lutticken et al. |
| 6,420,152 B1 | 7/2002 | Adams et al. |
| 6,579,711 B1 | 6/2003 | Gaier et al. |
| 6,635,623 B1 | 10/2003 | Hoogeveen et al. |
| 6,669,703 B2 | 12/2003 | Shue |
| 6,737,521 B1 | 5/2004 | Fischetti et al. |
| 6,747,437 B2 | 6/2004 | Chiu |
| 6,777,547 B1 | 8/2004 | Podbielski |
| 6,833,356 B1 | 12/2004 | Koenig et al. |
| 6,936,252 B2 | 8/2005 | Gilbert et al. |
| 7,033,765 B1 | 4/2006 | Dime et al. |
| 7,041,814 B1 | 5/2006 | Weinstock et al. |
| 7,098,182 B2 | 8/2006 | Le Page et al. |
| 7,101,692 B2 | 9/2006 | Schneewind et al. |
| 7,128,918 B1 | 10/2006 | Hamel et al. |
| 7,128,919 B2 | 10/2006 | Adderson et al. |
| 7,169,902 B2 | 1/2007 | Podbielski |
| 7,247,308 B2 | 7/2007 | Martin et al. |
| 7,348,006 B2 | 3/2008 | Contorni et al. |
| 7,407,664 B2 | 8/2008 | Beall et al. |
| 7,438,912 B2 | 10/2008 | Meinke et al. |
| 7,485,710 B2 | 2/2009 | Reinscheid et al. |
| 2002/0025516 A1 | 2/2002 | Black et al. |
| 2002/0045737 A1 | 4/2002 | Choi et al. |
| 2002/0061569 A1 | 5/2002 | Haselbeck et al. |
| 2002/0086023 A1 | 7/2002 | Dale |
| 2003/0035805 A1 | 2/2003 | Michel et al. |
| 2003/0109690 A1 | 6/2003 | Ruben et al. |
| 2003/0157122 A1 | 8/2003 | Dale |

(Continued)

FOREIGN PATENT DOCUMENTS

EP    0369825    5/1990

(Continued)

OTHER PUBLICATIONS

DATABASE UniProt Accession No. Q8P318, Oct. 1, 2002.

(Continued)

*Primary Examiner*—Robert B Mondesi
*Assistant Examiner*—Padma V Baskar
(74) *Attorney, Agent, or Firm*—Richard S. Pitman; Robert Gorman; Banner & Witcoff, Ltd.

(57) ABSTRACT

Group A streptococcal (GAS) antigens useful for providing immunity against *pyogenes* infection.

3 Claims, 145 Drawing Sheets

U.S. PATENT DOCUMENTS

| | | |
|---|---|---|
| 2003/0171337 A1 | 9/2003 | Aylward et al. |
| 2004/0029129 A1 | 2/2004 | Wang et al. |
| 2004/0101536 A1 | 5/2004 | Teti et al. |
| 2004/0219639 A1 | 11/2004 | Potter et al. |
| 2004/0236072 A1 | 11/2004 | Olmsted et al. |
| 2005/0019345 A1 | 1/2005 | Podbielski |
| 2005/0020813 A1 | 1/2005 | Masignani et al. |
| 2005/0181388 A1 | 8/2005 | Edwards et al. |
| 2005/0214918 A1 | 9/2005 | Edwards et al. |
| 2005/0288866 A1 | 12/2005 | Sachdeva |
| 2006/0039922 A1 | 2/2006 | Mizzen et al. |
| 2006/0041961 A1 | 2/2006 | Abad et al. |
| 2006/0073530 A1 | 4/2006 | Schneewind et al. |
| 2006/0115479 A1 | 6/2006 | Reinscheid et al. |
| 2006/0160121 A1 | 7/2006 | Mounts et al. |
| 2006/0165716 A1 | 7/2006 | Telford et al. |
| 2006/0194751 A1 | 8/2006 | Meinke et al. |
| 2006/0210579 A1 | 9/2006 | Telford et al. |
| 2006/0210580 A1 | 9/2006 | Telford et al. |
| 2006/0210581 A1 | 9/2006 | Telford et al. |
| 2006/0210582 A1 | 9/2006 | Telford et al. |
| 2006/0258849 A1 | 11/2006 | Telford et al. |
| 2006/0269541 A1 | 11/2006 | Meinke et al. |
| 2006/0275315 A1 | 12/2006 | Telford et al. |
| 2007/0036828 A1 | 2/2007 | Rappuoli et al. |
| 2007/0053924 A1 | 3/2007 | Tettelin et al. |
| 2007/0065464 A1 | 3/2007 | Bensi et al. |
| 2007/0098737 A1 | 5/2007 | Dale |
| 2007/0116712 A1 | 5/2007 | Hamel et al. |
| 2007/0128210 A1 | 6/2007 | Olmsted et al. |
| 2007/0128211 A1 | 6/2007 | Olmsted et al. |
| 2007/0128229 A1 | 6/2007 | Olmsted et al. |
| 2007/0141635 A1 | 6/2007 | James |
| 2008/0038268 A1 | 2/2008 | Martin et al. |
| 2008/0220010 A1 | 9/2008 | Telford et al. |
| 2009/0022753 A1 | 1/2009 | Olmsted et al. |
| 2009/0104218 A1 | 4/2009 | Tettelin et al. |
| 2009/0117113 A1 | 5/2009 | Bensi et al. |
| 2009/0162392 A1 | 6/2009 | Bensi et al. |

FOREIGN PATENT DOCUMENTS

| | | |
|---|---|---|
| EP | 0613947 | 1/1994 |
| EP | 555438 | 1/1997 |
| EP | 555439 | 10/1997 |
| EP | 1770171 | 4/2007 |
| GB | 2233977 | 1/1991 |
| WO | WO9006951 | 6/1990 |
| WO | WO9305155 | 3/1993 |
| WO | WO9305156 | 3/1993 |
| WO | WO9801561 | 1/1998 |
| WO | WO9818931 | 5/1998 |
| WO | WO9819689 | 5/1998 |
| WO | WO9823631 | 6/1998 |
| WO | WO9803677 | 8/1998 |
| WO | WO9913084 | 3/1999 |
| WO | WO9916882 | 4/1999 |
| WO | WO9926969 | 6/1999 |
| WO | WO9942588 | 8/1999 |
| WO | WO9954457 | 10/1999 |
| WO | WO0006736 | 2/2000 |
| WO | WO0006737 | 2/2000 |
| WO | WO0023456 | 4/2000 |
| WO | WO0062804 | 10/2000 |
| WO | WO0078787 | 12/2000 |
| WO | WO0132882 | 5/2001 |
| WO | WO0212294 | 2/2002 |
| WO | WO 02/34771 | 5/2002 |
| WO | WO2004078907 A2 * | 5/2002 |
| WO | WO02075507 | 9/2002 |
| WO | WO02077183 | 10/2002 |
| WO | WO02092818 | 11/2002 |
| WO | WO03068813 | 8/2003 |
| WO | WO03087353 | 10/2003 |
| WO | WO 03/093306 | 11/2003 |
| WO | WO2004035618 | 3/2004 |
| WO | WO 2004/018646 | 4/2004 |
| WO | WO2004041157 | 5/2004 |
| WO | WO 2004/078907 | 9/2004 |
| WO | WO02034771 A2 * | 9/2004 |
| WO | WO2004099242 | 11/2004 |
| WO | WO2005013666 | 2/2005 |
| WO | WO2005028618 | 3/2005 |
| WO | WO 2005/032582 | 4/2005 |
| WO | WO2005076010 | 8/2005 |
| WO | WO2005108419 | 11/2005 |
| WO | WO2006035311 | 4/2006 |
| WO | WO2006042027 | 4/2006 |
| WO | WO2006069200 | 6/2006 |
| WO | WO2006078318 | 7/2006 |
| WO | WO2006082527 | 8/2006 |
| WO | WO2006082530 | 8/2006 |
| WO | WO2006130328 | 12/2006 |
| WO | WO2007018563 | 2/2007 |
| WO | WO2007039319 | 4/2007 |
| WO | WO2007052168 | 5/2007 |
| WO | WO2008020335 | 2/2008 |
| WO | WO2008108830 | 9/2008 |
| WO | WO2008003515 | 10/2008 |
| WO | WO2009027768 | 3/2009 |

OTHER PUBLICATIONS

DATABASE UniProt Accession No. Q7CNQ7, Jul. 5, 2004.

DATABASE UniProt accession No. Q5XEL1, Nov. 23, 2004.

Banks et al., "Progress toward characterization of the Group A *Streptococcus metagenome*: Complete genome sequence of a macrolide-resistant serotype M6 strain," *J. Infectious Diseases 190*, 727-38, Aug. 15, 2004.

Ferretti et al., Complete genome sequence of an M1 strain of *Streptococcus pyogenes*, Proc. Natl. Acad. Sci. USA 98, 4658-63, Apr. 10, 2001.

Horvath et al., "Toward the development of a synthetic group a streptococcal vaccine of high purity and broad protective coverage," J Med Chem. Jul 29, 2004;47(16):4100-4.

Hughes et al., "Identification of Major Outer surface Proteins of *Streptococcus agalactiae*," *Inf. Immun. 70*, 1254-59, Mar. 2002.

Lei et al., "Identification of New Candidate Vaccine Antigens Made by *Streptococcus pyogenes*: Purification and Characterization of 16 Putative Extracellular Lipoproteins," *J. Infectious Diseases 189*, 79-89; published on-line Dec. 22, 2003.

McMillan et al., "Identification and assessment of new vaccine candidates for group A streptococcal infections," *Vaccine 22*, 2783-90, 2004.

McMillan et al., "Prospecting for new group A streptococcal vaccine candidates," *Indian J. Med. Res. 119*, 121-25, May 2004.

Nakagawa et al., "Genome sequence of an M3 strain of *Streptococcus pyogenes* reveals a large scale genomic rearrangement in invasive strains and new insights into phage evolution," *Genome Res. 13*, 1042-55, Jun. 2003.

Olive et al., "Protection of mice from group A streptococcal infection by intranasal immunisation with a peptide vaccine that contains a conserved M protein B cell epitope and lacks a T cell autoepitope," *Vaccine 20*, 2816-25, Jun. 21, 2002.

Smoot et al., "Genome sequence and comparative microarray analysis of serotype M18 group A *Streptococcus* strains associated with acute rheumatic fever outbreaks," *Proc. Natl. Acad. Sci. USA 99*, 4668-73, Apr. 2, 2002.

Abbas et al., *Cellular and Molecular Immunology*, 4th ed., Chapter 15, pp. 360-362, 2000.

Amara et al., "Molecular detection of methionine in rat brain using specific antibodies," Neurosci. Lett. 185, 147-50, Feb. 13, 1995.

Areschoug et al., "Group B streptococcal surface proteins as targets for protective antibodies: identification of two novel proteins in strains of serotype V.," Inf. Immun. 67(12), 6350-57, Dec. 1999.
Barnett & Scott, "Differential recognition of surface proteins in *Streptococcus pyogenes* by two sortase gene homologs," J. Bacteriol. 184, 2181-91, 2002.
Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.
Beckmann et al., "Identification of Novel Adhesins from Group B Streptococci by Use of Phage Display Reveals that C5a Peptidase Mediates Fibronectin Binding," *Inf. Immun.* 70, 2869-76, Jun. 2002.
Bessen et al., "Genomic Localization of a T Serotype Locus to a Recombinatorial Zone Ending Extracellular Matrix-Binding Proteins in *Streptococcus pyogenes*," Infection and Immunity, vol. 70, No. 3, pp. 1159-1167, Mar. 2002.
Black et al: "*Streptococcus pneumoniae* polypeptide coding region"; GENBANK Accession No. AAV42990, Nov. 9, 1998.
Blackburn et al., "The end of the (DNA) line," Nature Structural Biology 7, 847-49, Oct. 2000.
Bork et al., "Powers and pitfalls in sequence analysis: the 70% hurdle," Genome Research 10, 398-400, 2000.
Borovec et al., "Synthesis and assembly of hepatitis A virus-specific proteins in BS-C-1 cells," J. Virol. 67, 3095-301, Jun. 1993.
Bowie et al., "Deciphering the message in protein sequences: tolerance to amino acid substitution," Science 257, 1306-10, 1990.
Brodeur et al., "Identification of group B streptococcal Sip protein, which elicits cross-protective immunity," Inf. Immun. 68(10), 5610-8, Oct. 2000.
Burgess et al., "Possible dissociation of the heparin-binding and mitogenic activities of heparin-binding (acidic fibroblast) growth factor-1 from its receptor-binding activities by site-directed mutagenesis of a single lysine residue," J. Cell Biol. 111, 2129-38, 1990.
Chung et al., "chlorosome protein," NCBI Accession No. 2115394F, Jul. 10, 1992.
Clancy et al., "Cloning and Characterization of a Novel Macrolide Efflux Gene, mreA, from *Streptococcus agalactiae*," Antimicrobial Agents and Chemotherapy 41, 2719-23, 1997.
Collins et al., "Mutation of the principal sigma factor causes loss of virulence in a strain of the *Mycobacterium tuberculosis* complex," Proc. Natl. Acad. Sci. USA 92, 8036-40, 1995.
Dale et al., "New Protective Antigen of Group A *Streptococci*," J. Clin. Invest. 103, 1261-68, May 1999.
Dale et al., "Recombinant, octavalent group A streptococcal M protein vaccine," Vaccine 14, 944-48, 1996.
Dale, "Group A Streptococcal Vaccines," Infectious Disease Clinics of North America 13, 227-43, Mar. 1999.
Dale, "Multivalent group A streptococcal vaccine designed to optimize the immunogenicity of six tandem M protein fragments," Vaccine 17, 193-200, 1999.
DATABASE EMBL, Accession No. AAX13129, *Enterococcus faecalis* genome contig SEQ ID No. 192, Mar. 19, 1999.
DATABASE EPO Proteins, EBI Accession No. AX605513, "Sequence 3442 from WO0209818," Feb. 17, 2003.
DATABASE Geneseq, "Group B *Streptococcus* protein sequence SEQ ID No. 49," EBI Accession No. GSP:AAY91320, May 30, 2000.
DATABASE Geneseq, "*Streptococcus agalactiae* protein, SEQ ID 2382," EBI Accession No. GSP:ADV81242, Feb. 24, 2005.
DATABASE Geneseq, "Fibrinogen-binding polypeptide, SEQ ID No. 17," EBI Accession No. GSP: ADS93952, Dec. 2, 2004; revised in 2007.
DATABASE Geneseq, EBI Accession No. GSP: ABP30134, "*Streptococcus* polypeptide SEQ ID No. 9444," Jul. 2, 2002.
DATABASE Geneseq, EBI Accession No. GSP: ABP27285, "*Streptococcus* polypeptide SEQ ID No. 3746," Jul. 2, 2002; revised in 2007.
DATABASE Genseq, "Protein encoded by Prokaryotic essential gene #319788," Accession No. ABU46451, Jun. 13, 2003.
DATABASE JPO Proteins, "Nucleic acid and protein originating in group B *Streptococcus*," EBI Accession No. JPOP:BD629260, Jul. 17, 2003.
Database Swissprot[Online] Oct. 1, 2002, accession No. EBI, Database accession No. Q9PGX9, Hypothetical protein XF0167.
DATABASE UniProt [Online] Mar. 1, 2003, "Cell wall surface anchor family protein," retrieved from EBI accession No. UNIPROT: Q8DYR5, Database accession No. Q8DYR5, 87.2% identity with SEQ ID No. 20906.
DATABASE UniProt [Online], Nov. 22, 2005, "Cell wall surface anchor family protein," retrieved from EBI accession No. UNIPROT: Q3D2D6; 100% identity with SEQ ID No. 20906; abstract.
De Boever et al., "*Enterococcus faecalis* conjugative plasmid pAM373. Complete nucleotide sequence and genetic analyses of sec phermone response," Mol. Microbiol. 37, 1327-41, 2000.
Dittmer et al., "Treatment of infectious diseases with immunostimulatory oligodeoxynucleotides containing CpG motifs," Curr. Opinion Microbiol. 6, 472-77, Oct. 2003.
Duez, "*Enterococcus hirae* mraR, pbp3s, mraY, murD, murG, ftsQ and ftsA genes, mraW, yllC and ftsZ partial genes," GENBANK Accesion No. Y13922, Apr. 18, 2005.
Ellis, *Vaccines*, Chapter 29, Plotkin et al., eds., W.B. Saunders Company (Philadelphia), pp. 568-575, 1988.
Examination Report for NZ 560966, Mar. 4, 2009, 2 pages.
Ferretti et al., "Putative surface exclusion protein," GENBANK Accession No. Q9A1H3, Oct. 31, 2006.
Ferretti et al: "*Streptococcus pyogenes* M1 GAS strain SF370, Section 87 of 167 of the complete genome" DATABASE Accession No. AE006558, 2001.
Glaser et al., "Genome sequence of *Streptococcus agalactiae*, a pathogen causing invasive neonatal disease," Mol. Moicrobiol. 45, 1499-1513, 2002.
Grandi & Zagursky, "The impact of genomics in vaccine discovery: achievements and lessons," Expert. Rev. Vaccines 3, 621-23, 2004.
Grandi, "Genomics and Proteomics in Reverse Vaccines," in *Microbial Proteomics: Functional Biology of Whole Organisms*, Humphery-Smith & Hecker, eds., John Wiley & Sons, chapter 20, 2006.
Greenspan et al., "Defining epitopes: It's not as easy as it seems," Nature Biotechnol. 7, 936-37, 1999.
Gutekunst et al., "Analysis of RogB-Controlled Virulence Mechanisms and Gene Expression in *Streptococcus agalactiae*," *Inf. Immun. 71*, 5056-64, Sep. 2003.
Gutierrez et al., "insertional Mutagenesis and Recovery of Interrupted Genes of *Streptococcus mutans* by Using Transposon Tn917: Preliminary Characterization of Mutants Displaying Acid Sensitivity and Nutritional Requirements," J. Bacteriol. 178, 4166-75, Jul. 1996.
Guttierez et al., "*Streptococcus mutans* ProX (pouABC) gene, partial cds; YlxM (ylxM) gene, complete cds; Ffh (ffh) gene, complete cds, alternatively spliced; SatC (satC) and SatD (satD) gene, complete cds; and SatE (satE) gene, partical cds," GENBANK Accession No. U88582, Apr. 3, 2001.
Guzman et al., "Protective immune response against *Streptococcus pyogenes* in mice after intranasal vaccination with the fibronectin-binding protein SfbI," J. Infectious Disease 179, 901-06, 1999.
Holmes, "PSMA specific antibodies and their diagnostic and therapeutic use," Exp. Opin. Invest. Drugs 10, 511-10, 2001.
Hong, "unnamed protein product [*Streptococcus pyogenes*]," NCBI Accession No. BAB1603, one page, Oct. 3, 2000.
International Preliminary Examination Report for PCT/GB01/04789 (published as WO 02/34771) dated Feb. 17, 2003.
International Preliminary Examination Report for PCT/GB2003/001882 (published as WO 03/093306) dated Aug. 18, 2004.
International Preliminary Examination Report for PCT/US2005/036009 (published as WO 06/042027) dated Apr. 11, 2007.
International Preliminary Examination Report for PCT/US2003/029167 (published as WO 04/041157) dated Mar. 5, 2005.
International Preliminary Examination Report for PCT/US2004/024868 (published as WO 05/032582) dated Feb. 6, 2006.
International Preliminary Examination Report for PCT/US2004/030032 (published as WO 05/028618) dated Mar. 16, 2006.
International Search Report for PCT/GB01/04789 (published as WO 02/34771) dated Aug. 27, 2002.
International Search Report for PCT/GB2003/001882 (published as WO 03/093306) dated Nov. 14, 2002.

International Search Report for PCT/IB2005/036009 (published as WO 06/042027) dated Jun. 20, 2006.
International Search Report for PCT/US05/046491 dated Jun. 26, 2007 (published as WO 2006/069200).
International Search Report for PCT/US2003/029167 (published as WO 04/041157) dated Aug. 2, 2004.
International Search Report for PCT/US2004/024868 (published as WO 05/032582) dated Oct. 28, 2005.
International Search Report for PCT/US2004/030032 (published as WO 05/028618) dated Dec. 6, 2005.
International Search Report for PCT/US2005/027239 (published as WO 06/078318) dated Aug. 25, 2008.
International Search Report for PCT/US2007/022838 (published as WO 08/108830) dated Oct. 9, 2008.
Jobling et al., "Analysis of structure and function of the B subunit of cholera toxin by the use of site-directed mutagenesis," Mol. Microbiol. 5, 1755-67, 1991.
Kalman et al., "Comparative genomes of *Chlamydia pneumoniae* and *C. trachomatis*," Nature Genetics 21, 385-89, Apr. 1999.
Kehoe et al., "Nucleotide Sequence of the Streptolysin O (SLO) Gene: Structural Homologies between SLO and Other Membrane-Damaging, Thiol-Activated Toxins," Inf. Immun. 55, 3228-32, Dec. 1987.
Koch et al., "Complexity and expression patterns of the desmosomal adherins," Proc. Natl. Acad. Sci. USA 89, 353-57, Jan. 1992.
Kunst et al., "The complete genome sequence of the Gram positive bacterium *Bacillus subtilis*," NCBI Accession No. CAB14964, Nov. 20, 1997.
Lachenauer et al., "A protective surface protein from the Type V Group B *Streptococcus* shares N-terminal sequence homology with the Alpha C Protein," Inf. Immun. 64, 4255-60, Oct. 1996.
Larsson et al., "Protection against experimental infection with group B *Streptococcus* by immunization with a bivalent protein vaccine," Vaccine 17, 454-58, 1999.
Lauer et al., "Genome Analysis Reveals Pili in Group B *Streptococcus*," Science 309, 105, Jul. 1, 2005.
Lazar et al., "Transforming growth factor alpha: mutation of aspartic acid 47 and leucine 48 results in different biological activities," Mol. Cell. Biol. 8, 1247-52, 1988.
Le Page et al., *Streptococcus agalactiae* sequence 217 from WO 01/32882, GENBANK Accession No. AX134653, May 29, 2001.
Lewis, "Riddle of Biofilm Resistance," *Antimicrobial Agents and Chemotherapy*, vol. 45, No. 4, pp. 999-1007, Apr. 2001.
Lindahl et al., "Surface proteins of *Streptococcus agalactiae* and related proteins in other bacterial pathogens," Clinical Microbiol. Rev. 18(1), 102-07, Jan. 2005.
Madoff et al., "Maternal Immunization of Mice with Group B Streptococcal Type III Polysaccharide-Beta C Protein Conjugate Elicits Protective Antibody to Multiple Serotypes," J. Clinical Invest. 94, 286-92, 1994.
Maione et al., "Identification of a Universal Group B *Streptococcus* Vaccine by Multiple Genome Screen," Science 309, 148-50, Jul. 1, 2005.
Meehan & Owen, "Sequence 1 from Patent WO9801561," GENBANK Accession No. A68631, May 6, 1999.
Meinke et al., "*S. pyogenes* hyperimmune system reactive antigen Spy0269," EBI Accession No. ADR83896, Dec. 2, 2004; revised Jun. 15, 2007.
Michel et al: "Cloned alpha and beta C-protein antigens of group B *Streptococci* elicit protective immunity"; Infection and Immunity; vol. 59, No. 6, Jun. 1991; pp. 2023-2028.
Molling et al., "Naked DNA for vaccine or therapy," J. Mol. Med. 75, 242-46, 1997.
Mora et al., "Group A *Streptococcus* produce pilus-like structures containing protective antigens and Lancefield T antigens," Proc. Natl. Acad. Sci. USA 102, 15641-46, Oct. 25, 2005.
Musser, "The Next Chapter in Reverse Vaccinology," Nat. Biotechnol. 24, 157-58, 2006.
Nakata et al., "MsmR, a specific positive regulator of the *Streptococcus pyogenes* FCT pathogenicity region and cytolysin-mediated translocation system genes," Mol. Microbiol. 57, 786-803, 2005.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.
NCBI News, table on p. 4, "Microbial Genomes Available for BLAST Search," Jul. 1998.
Orefici et al., "Possible virulence marker for *Streptococcus agalactiae* (Lancefiled Group B)," J. Clin. Microbiol. Infectious Diseases 7, 302-05, 1988.
Paoletti et al., "Neonatal mouse protection against infection with multiple group B streptococcal (GBS) serotypes by maternal immunization with a tetravalent GBS polysaccharide-tetanus toxoid conjugate vaccine," Inf. Immun. 62, 3236-43, 1994.
Paoletti, "Surface structure of group B *Streptoccoccus* important in human immunity," in *Gram Positive Pathogens*, Fischetti et al., eds., Chapter 14, pp. 137-153, 2000.
Pournaras et al., "Pheromone responses and high-level aminoglycoside resistance of conjugative plasmids of *Enterococcus faecalis* from Greece," J. Antimicrobial Chemotherapy 46, 1013-16, 2000.
Pritzlaff et al., "Genetic basis for the beta-haemolytic cytolitic activity of group B *Streptococcus*," Mol. Microbiol. 39, 236-48, 2001.
Pritzlaff et al., "*Streptococcus agalactiae* cyl gene cluster, partial sequence," GENBANK Accession No. AF157015, Feb. 8, 2001.
Proft et al., "Identification and Characterization of Novel Superantigens from *Streptococcus pyogenes*," J. Exp. Med. 189, 89-101, Jan. 4, 1999.
Pucci et al., "*Enterococcus faecalis* strain A24836 cell wall/cell division gene cluster, yllB, yllc, yllD, pbpC, mraY, murD, murG, divlB, ftsA and fitsZ genes, complete cds," GENBANK Accession No. U94707, Sep. 10, 1997.
Quinn, "The response of rheumatic and non-rheumatic children to streptolysin O concentrate," J. Clin. Invest. 36, 793-802, Jun. 1957.
Ramachandran et al., "Two Distinct Genotypes of *prtF2*, Encoding a Fibronectin Binding Protein, and Evolution of the Gene Family in *Streptococcus pyogenes*," Journal of Bacteriology, vol. 186, No. 22, pp. 7601-7609, Nov. 2004.
Rodewald et al., "Neonatal mouse model of group b Streptococcal infection," J. Infectious Diseases 166, 635-39, 1992.
Rodriguez-Ortega et al., "Characterization and identification of vaccine candidate proteins through analysis of the group A *Streptococcus* surface proteome," Nature Biotechnol. 24, 191-97, 2006.
Roitt et al., Structure of Antigens, *Immunology*, 4th ed., Mosby, London, pp. 7.7 and 7.8, 1998.
Rosini et al., "Identification of novel genomic islands coding for antigenic pilus-like structures in *Streptococcus agalactiae*," Mol. Microbiol. 61, 126-41, 2006.
Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.
Rudinger et al., "Characteristics of the amino acids as components of a peptide hormone sequence," in *Peptide Hormones*, Parsons, ed., University Park Press, Jun. 1976, pp. 1-7.
Schneewind et al., "Sequence and Structural Characteristics of the Trypsin-Resistant T6 Surface Protein of Group A Streptococci," *Journal of Bacteriology*, vol. 172, No. 6, pp. 3310-3317, Jun. 1990.
Schneewind, "Structure of the Cell Wall anchor of Surface Proteins in *Staphylococcus aureus*," Science 268, 103-06, Apr. 7, 1995.
Segura et al., "*Streptococcus suis* and group B *Streptococcus* differ in their interactions with murine macrophages," FEMS Immunol. Med. Microbiol. 21, 189-95, 1998.
Seizen, "Multi-domain, cell envelope proteases of lactic acid bacteria," Antonie von Leeuwenhoek 76, 139-55, 1999.
Simpson et al., "Xylella fastidiosa 9a5c, section 136 of 229 of the complete genome," GENBANK Accession No. AE003990, Jun. 4, 2004.
Spellerberg et al., "*Streptococcus agalactiae* cyl gene cluster, complete sequence," GENBANK Accession No. AF093787, Jul. 31, 2000.
Spellerberg et al: "Identification of genetic determinants for the hemolytic activity of *Streptococcus agalactiae* by ISSI transposition"; J. Bacteriol.; vol. 181, No. 10, May 1999; pp. 3212-3219.

Stalhammar-Carlemalm et al: "The R28 Protein of Streptococcus pyogenes is related to several group B streptococcal surface proteins, confer protective immunity and promotes binding to human epithelial cells"; Mol. Microbiol. 1, Jul. 1999, pp. 208-219.

Stephenson et al., "The Fap1 fimbrial adhesin is a glycoprotein: antibodies specific for the glycan moiety block the adhesion of Streptococcus parasanguis in an in vitro tooth model," Mol. Microbiol. 43, 147-57, 2002.

Su et al., "Identification of a Xenopus cDNA that prevents mitotic catastrophe in the fission yeast Schizosaccharomyces pombe," Gene 145, 155-56, 1994.

Supplementary Search report for EP 03799822 (corresponding to WO 04/041157) dated Jan. 21, 2008.

Surovov & Ferretti, "Physical and Genetic Chromosomal Map of an M Type 1 Strain of Streptococcus pyogenes," J. Bacteriol. 178, 5546-49, Sep. 1996.

Takami et al., "Two component sensor histidine kinase involved in phosphate regulation," NCBI Accession No. NP_244022.1, Sep. 10, 2001.

Telford et al., Sequence 7466 from WO 02/34771, EBI Accession No. CQ650509, Feb. 2, 2004; modified May 31, 2006.

Telford et al., "Streptococcus polypeptide SEQ ID No. 9188" of WO 02/34771, EBI Accession No. ABP300006, Jul. 2, 2002; revised Jun. 15, 1007.

Tettelin et al., "Complete genome sequence and comparative genomic analysis of an emerging human pathogen, serotype V Streptococcus agalactiae," Proc. Natl. Acad. Sci. USA 99, 12391-96, Sep. 17, 2002.

Tettelin et al., "Complete genome sequence of a virulent isolate of Streptococcus pneumoniae," Science 293, 498-506, 2001.

Tettelin et al., DATABASE EMBL, Accession No. AE014193, Streptococcus agalactiae 2603V/R section 3 of 100 of the complete genome, Sep. 2, 2002.

Tettelin et al., Swiss-Prot Accession No. Q3DV91 for Streptococcus agalactiae strain 18R21, Nov. 22, 2005.

Tighe et al., "Gene vaccination: plasmid DNA is more than just a blueprint," Immunology Today 19, 89-97, Feb. 1998.

Todd, "Antigenic Streptococcal Hemolysin," J. Exp. Med. 55, 267-80, 1932.

Ton-That & Schneewind, "Assembly of pili on the surface of Corynebacterium diphtheriae," Mol. Microbiol. 50, 1429-38, 2003.

Ton-That et al., "Sortases and pilin elements involved in pilus assembly of Corynebacterium diphtheriae," Mol. Microbiol. 53, 251-61, 2004.

Vallet et al., "The chaperone/usher pathways of Pseudomonas aeruginosa: Identification of fimbrial gene clusters (cup) and their involvement in biofilm formation," PNAS, vol. 98, No. 12, pp. 6911-6916, Jun. 2001.

Wang et al., "Protein encoded by prokaryotic essential gene #31978," EBI Accession No. ABU46451, Jun. 19, 2003; revised Jun. 15, 2007.

Watnick et al., "Steps in the development of a Vibrio cholerae El Tor biofilm," Molecular Microbiology, vol. 34, No. 3, pp. 586-595, 1999.

Wessels et al., "Stimulation of protective antibodies against type 1a and 1b group B streptococci by a type 1a polysaccharide-tetanus toxoid conjugate vaccine," Inf. Immun. 61, 4760-66, 1993.

Woodson et al., "Analysis of a ribose transport operon from Bacillus subtilis," Microbiology 140, 1829-38, 1994.

Zhong et al., "Hypothetical protein of Arabidopsis thaliana," NCBI Accession No. AAD29767, May 11, 1999.

* cited by examiner

FIG. 1A

```
            1                                                        50
(SF370)  MDLEQTKPNQ VKQKIALTST IALLSASVGV SHQVKADDRA SGETKASNTH  (M1)
(2634)   MDLEQTKPNQ VKQKIALTST IALLSASVGV SHQVKADDRA SGETKASNTH  (M1)
(2580)   MDLEQTKPNQ VKQKIALTST IALLSASVGV SHQVKADDRA SGETKASNTH  (M1)
(3280)   MDLEQTKPNQ VKQKIALTST IALLSASVGV SHQVKADDRA SGETKASNTH  (M1)
(3348)   MDLEQTKPNQ VKQKIALTST IALLSASVGV SHQVKADDRA SGETKASNTH  (M1)
(2913)   MDLEQTKPNQ VKQKIALTST IALLSASVGV SHQVKADDRA SGETKASNTH  (M1)

(2726)   MDLEQPKPNQ VKQKIALTST IALLSASVGV SHHVKADDLA PEGAKASNTS  (M2)

(2721)   MDLEQTKPNQ VKQKIALTST IALLSASVGV SHQVKADDRA SGETKASNTH  (M3)
(3040)   MDLEQTKPNQ VKQKIALTST IALLSASVGV SHQVKADDRA SGETKASNTH  (M3)
(3135)   MDLEQTKPNQ VKQKIALTST IALLSASVGV SHQVKADDRA SGETKASNTH  (M3)

(2722)   MDLEQTKPNQ VKQKIALTST IALLSASVGV SHQVKADDRA SGETKASNTH  (M4)
(2728)   MDLEQTKPNQ VKQKIALTST IALLSASVGV SHQVKADDRA SGETKASNTH  (M4)

(4883)   MDLEQTKPNQ VKQKIALTST IALLSASVGV SHQVKADDRA SEETKASNTH  (M5)

(2724)   MDLEQTKPNQ VKQKIALTST IALLSASVGV SHQVKADDRA SGETKASNTH  (M6)
(2894)   MDLEQTKPNQ VKQKIALTST IALLSASVGV SHQVKADDRA SGETKASNTH  (M6)
(3650)   MDLEQTKPNQ VKQKIALTST IALLSASVGV SHQVKADDRA SGETKASNTH  (M6)
(5529)   MDLEQTKPNQ VKQKIALTST IALLSASVGV SHQVKADDRA SGETKASNTH  (M6)

(2720)   MDLEQTKPNQ VKQKIALTST IALLSASVGV SHQVKADDRA SGETKASNTH  (M9)
(2725)   MDLEQTKPNQ VKQKIALTST IALLSASVGV SHQVKADDRA SGETKASNTH  (M8)
(4538)   MDLEQTKPNQ VKQKIALTST IALLSASVGV SHQVKADDRA SGETKASNTH  (M50)
(5455)   MDLEQTKPNQ VKQKIALTST IALLSASVGV SHQVKADDRA SGETKASNTH  (M62)
(5531)   MDLEQTKPNQ VKQKIALTST IALLSASVGV SHQVKADDRA SGETKASNTH  (M75)

(3776)   MDLEQTKPNQ VKQKIALTST IALLSASVGV SHQVKADDRA SGETKASNTH  (M44)
(5481)   MDLEQTKPNQ VKQKIALTST IALLSASVGV SHQVKADDRA SEETKASNTH  (M44)

(4959)   MDLEQTKPNQ VKQKIALTST IALLSASVGV SHQVKADDRA SGETKASNTH  (M77)
(D2071)  MDLEQTKPNQ VKQKIALTST IALLSASVGV SHQVKADDRA SGETKASNTH  (M23)
(4436)   MDLEQTKPNQ VKQKIALTST IALLSASVGV SHQVKADDRA SGETKASNTH  (M28)
(2727)   MDLEQTKPNQ VKQKIALTST IALLSASVGV SHQVKADDRA SGETKASNTH  (M11)
(2719)   MDLEQTKPNQ VKQKIALTST IALLSASVGV SHQVKADDRA SGETKASNTH  (M?)
(3789)   MDLEQTKPNQ VKQKIALTST IALLSASVGV SHQVKADDRA SGETKASNTH  (M78)
(5476)   MDLEQTKPNQ VKQKIALTST IALLSASVGV SHQVKADDRA SGETKASNTH  (M89)
(4088)   MDLEQTKPNQ VKQKIALTST IALLSASVGV SHQVKADDRA SGETKASNTH  (M?)

(MANFR)  MDLEQTKPNQ VKQKIALTST IALLSASVGV SHQVKADDRA SGETKASNTH  (M5)
(M8232)  MDLEQTKPNQ VKQKIALTST IALLSASVGV SHQVKADDRA SGETKASNTH  (M18)
(M315)   MDLEQTKPNQ VKQKIALTST IALLSASVGV SHQVKADDRA SGETKASNTH  (M3)
(SS1)    MDLEQTKPNQ VKQKIALTST IALLSASVGV SHQVKADDRA SGETKASNTH  (M3)
```

FIG. 1B

```
              51                                                      100
(SF370)   DDSLPKPETI QEAKATIDAV EKTLSQQKAE LTELATALTK TTAEINHLKE  (M1)
(2634)    DDSLPKPETI QEAKATIDAV EKTLSQQKAE LTKLATALTK TTAEINHLKE  (M1)
(2580)    DDSLPKPETI QEAKATIDAV EKTLSQQKAE LTELATALTK TTAEINHLKE  (M1)
(3280)    DDSLPKPETI QEAKATIDAV EKTLSQQKAE LTELATALTK TTAEINHLKE  (M1)
(3348)    DDSLPKPETI QEAKATIDAV EKTLSQQKAE LTELATALTK TTAEINHLKE  (M1)
(2913)    DDSLPKPETI QEAKATIDAV EKTLSQQKAE LTELATALTK TTAEINHLKE  (M1)

(2726)    EESLPKTETC EEAKAAVEAV ETNLNQQKAE LTELATALTK TTAEINHLKE  (M2)

(2721)    DDSLPKPETI QEAKATIDAV EKTLSQQKAE LTELATALTK TTAEINHLKE  (M3)
(3040)    DDSLPKPETI QEAKATIDAV EKTLSQQKAE LTELATALTK TTAEINHLKE  (M3)
(3135)    DDSLPKPETI QEAKATIDAV EKTLSQQKAE LTELATALTK TTAEINHLKE  (M3)

(2722)    DDSLPKPETI QEAKATIDAV EKTLSQQKAE LTKLATALTK TTAEINHLKE  (M4)
(2728)    DDSLPKPETI QEAKATIDAV EKTLSQQKAE LTELATALTK TTAEINHLKE  (M4)

(4883)    DDSLPKPETI QEAKATIEAV EKTLSQQKTK LTELATALTK TTAEINHLKE  (M5)

(2724)    DDSLPKPETI QEAKATIDAV EKTLSQQKAE LTELATALTK TTAEINHLKE  (M6)
(2894)    DDSLPKPETI QEAKATIDAV EKTLSQQKAE LTELATALTK TTAEINHLKE  (M6)
(3650)    DDSLPKPETI QEAKATIDAV EKTLSQQKAE LTELATALTK TTAEINHLKE  (M6)
(5529)    DDSLPKPETI QEAKATIDAV EKTLSQQKAE LTELATALTK TTAEINHLKE  (M6)

(2720)    DDSLPKPETI QEAKATIEAV EKTLSQQKAK LTELATALTK TTAEINHLKE  (M9)
(2725)    DDSLPKPETI QEAKATIDAV EKTLSQQKAE LTELATALTK TTAEINNLKE  (M8)
(4538)    DDSLPKPETI QEAKATIEAV EKTLSQQKAK LTELATALTK TTAEINHLKE  (M50)
(5455)    DDSLPKPETI QEAKATIEAV EKTLSQQKAK LTELATALTK TTAEINHLKE  (M62)
(5531)    DDSLPKPETI QEAKATIEAV EKTLSQQKTK LTELATALTK TTAEINHLKE  (M75)

(3776)    DDSLPKPETI QEAKATIDAV EKTLSQQKAE LTELATALTK TTAEINHLKE  (M44)
(5481)    DDSLPKPETI QEAKATIEAV EKTLSQQKTK LTELATALTK TTAEINHLKE  (M44)

(4959)    DDSLPKPETI QEAKATIDAV EKTLSQQKAE LTELATALTK TTAEINHLKE  (M77)
(D2071)   DDSLPKPETI QEAKATIDAV EKTLSQQKAE LTKLATALTK TTAEINHLKE  (M23)
(4436)    DDSLPKPETI QEAKATIDAV EKTLSQQKAE LTELATALTK TTAEINHLKE  (M28)
(2727)    DDSLPKPETI QEAKATIEAV EKTLSQQKAE LTELATALTK TTAEINHLKE  (M11)
(2719)    DDSLPKPETI QEAKATIDAV EKTLSQQKAE LTELATALTK TTAEINHLKE  (M?)
(3789)    DDSLPKPETI QEAKATIDAV EKTLSQQKAE LTELATALTK TTAEINHLKE  (M78)
(5476)    DDSLPKPETI QEAKATIDAV EKTLSQQKAE LTELATALTK TTAEINNLKE  (M89)
(4088)    DDSLPKPETI QEAKATIEAV EKTLSQQKAE LTELATALTK TTAEINHLKE  (M?)

(MANFR)   DDSLPKPETI QEAKATIDAV EKTLSQQKAE LTELATALTK TTAEINHLKE  (M5)
(M8232)   DDSLPKPETI QEAKATIDAV EKTLSQQKAE LTELATALTK TTAEINHLKE  (M18)
(M315)    DDSLPKPETI QEAKATIDAV EKTLSQQKAE LTELATALTK TTAEINHLKE  (M3)
(SS1)     DDSLPKPETI QEAKATIDAV EKTLSQQKAE LTELATALTK TTAEINHLKE  (M3)
```

FIG. 1C

```
            101                                                          150
(SF370)   QQDNEQKALT SAQEIYTNTL ASSEETLLAQ GAEHQRELTA TETELHNAQA (M1)
(2634)    QQDNEQKALT SAQEIYTNTL ASSEETLLAQ GAEHQRELTA TETELHNAQV (M1)
(2580)    QQDNEQKALT SAQEIYTNTL ASSEETLLAQ GAEHQRELTA TETELHNAQA (M1)
(3280)    QQDNEQKALT SAQEIYTNTL ASSEETLLAQ GAEHQRELTA TETELHNAQA (M1)
(3348)    QQDNEQKALT SAQEIYTNTL ASSEETLLAQ GAEHQRELTA TETELHNAQA (M1)
(2913)    QQDNEQKALT SAQEIYTNTL ASSEETLLAQ GAEHQRELTA TETELHNAQA (M1)

(2726)    QQDNEQKALT SAQEIYTNTL ASSEETLLAQ GAEYQRELTA TETELHNAQV (M2)

(2721)    QQDNEQKALT SAQEIYTNTL ASSEETLLAQ GAEHQRELTA TETELHNAQV (M3)
(3040)    QQDNEQKALT SAQEIYTNTL ASSEETLLAQ GAEHQRELTA TETELHNAQV (M3)
(3135)    QQDNEQKALT SAQEIYTNTL ASSEETLLAQ GAEHQRELTA TETELHNAQV (M3)

(2722)    QQDNEQKALT SAQEIYTNTL ASSEETLLAQ GAEHQRELTA TETELHNAQA (M4)
(2728)    QQDNEQKALT SAQEIYTNTL ASSEETLLAQ GAEHQRELTA TETELHNAQA (M4)

(4883)    QQDNEQKALT SAQEIYTNTL ASSEETLLAQ GAEHQRELTA TETELHNAQA (M5)

(2724)    QQDNEQKALT SAQEIYTNTL ASSEETLLAQ GAEHQRELTA TETELHNAQV (M6)
(2894)    QQDNEQKALT SAQEIYTNTL ASSEETLLAQ GAEHQRELTA TETELHNAQV (M6)
(3650)    QQDNEQKALT SAQEIYTNTL ASSEETLLAQ GAEHQRELTA TETELHNAQV (M6)
(5529)    QQDNEQKALT SAQEIYTNTL ASSEETLLAQ GAEHQRELTA TETELHNAQV (M6)

(2720)    QQDNEQKALT SAQEIYTNTL ASSEETLLAQ GAEHQRELTA TETELHNAQV (M9)
(2725)    QQDNEQKALT SAQEIYTNTL ASSEETLLAQ GAEHQRELTA TETELHNAQA (M8)
(4538)    QQDNEQKALT SAQEIYTNTL ASSEETLLAQ GAEHQRELTA TETELHNAQA (M50)
(5455)    QQDNEQKALT SAQEIYTNTL ASSEETLLAQ GAEHQRELTA TETELHNAQA (M62)
(5531)    QQDNEQKALT SAQEIYTNTL ASSEETLLAQ GAEHQRELTA TETELHNAQA (M75)

(3776)    QQDNEQKALT SAQEIYTNTL ASSEETLLAQ GAEHQRELTA TETELHNAQV (M44)
(5481)    QQDNEQKALT SAQEIYTNTL ASSEETLLAQ GAEHQRELTA TETELHNAQA (M44)

(4959)    QQDNEQKALT SAQEIYTNTL ASSEETLLAQ GAEHQRELTA TETELHNAQA (M77)
(D2071)   QQDNEQKALT SAQEIYTNTL ASSEETLLAQ GAEHQRELTA TETELHNAQA (M23)
(4436)    QQDNEQKALT SAQEIYTNTL ASSEETLLAQ GAEHQRELTA TETELHNAQA (M28)
(2727)    QQDNEQKALT SAQEIYTNTL ASSEETLLAQ GAEHQRELTA TETELHNAQA (M11)
(2719)    QQDNEQKALT SAQEIYTNTL ASSEETLLAQ GAEHQRELTA TETELHNAQA (M?)
(3789)    QQDNEQKALT SAQEIYTNTL ASSEETLLAQ GAEHQRELTA TETELHNAQA (M78)
(5476)    QQDNEQKALT SAQEIYTNTL ASSEETLLAQ GAEHQRELTA TETELHNAQA (M89)
(4088)    QQDNEQKALT SAQEIYTNTL ASSEETLLAQ GAEHQRELTA TETELHNAQA (M?)

(MANFR)   QQDNEQKALT SAQEIYTNTL ASSEETLLAQ GAEHQRELTA TETELHNAQV (M5)
(M8232)   QQDNEQKALT SAQEIYTNTL ASSEETLLAQ GAEHQRELTA TETELHNAQA (M18)
(M315)    QQDNEQKALT SAQEIYTNTL ASSEETLLAQ GAEHQRELTA TETELHNAQV (M3)
(SS1)     QQDNEQKALT SAQEIYTNTL ASSEETLLAQ GAEHQRELTA TETELHNAQV (M3)
```

FIG. 1D

```
            151                                                200
(SF370)  DQHSKETALS EQKASISAET TRAQDLVEQV KTSEQNIAKL NAMISNPDAI  (M1)
(2634)   DQHSKETALS EQKASISAET TRAQDLVEQV KTSEQNIAKL NAMISNPDAI  (M1)
(2580)   DQHSKETALS EQKASISAET TRAQDLVEQV KTSEQNIAKL NAMISNPDAI  (M1)
(3280)   DQHSKETALS EQKASISAET TRAQDLVEQV KTSEQNIAKL NAMISNPDAI  (M1)
(3348)   DQHSKETALS EQKASISAET TRAQDLVEQV KTSEQNIAKL NAMISNPDAI  (M1)
(2913)   DQHSKETALS EQKASISAET TRAQDLVEQV KTSEQNIAKL NAMISNPDAI  (M1)

(2726)   DQHSKETALS EQKASISAET TRAQDLVEQV KTSEQNIAKL NAMISNPDAI  (M2)

(2721)   DQHSKETALS EQKASISAET TRAQDLVEQV KTSEQNIAKL NAMISNPDAI  (M3)
(3040)   DQHSKETALS EQKASISAET TRAQDLVEQV KTSEQNIAKL NAMISNPDAI  (M3)
(3135)   DQHSKETALS EQKASISAET TRAQDLVEQV KTSEQNIAKL NAMISNPDAI  (M3)

(2722)   DQHSKETALS EQKASISAET TRAQDLVEQV KTSEQNIAKL NAMISNPDAI  (M4)
(2728)   DQHSKETALS EQKASISAET TRAQDLVEQV KTSEQNIAKL NAMISNPDAI  (M4)

(4883)   DQHSKETALS EQKASISAET TRAQDLVEQV KTSEQNIAKL NAMISNPDAI  (M5)

(2724)   DQHSKETALS EQKASISAET TRAQDLVEQV KTSEQNIAKL NAMISNPDAI  (M6)
(2894)   DQHSKETALS EQKASISAET TRAQDLVEQV KTSEQNIAKL NAMISNPDAI  (M6)
(3650)   DQHSKETALS EQKASISAET TRAQDLVEQV KTSEQNIAKL NAMISNPDAI  (M6)
(5529)   DQHSKETALS EQKASISAET TRAQDLVEQV KTSEQNIAKL NAMISNPDAI  (M6)

(2720)   DQHSKETALS EQKASISAET TRAQDLVEQV KTSEQNIAKL NAMISNPDAI  (M9)
(2725)   DQHSKETALS EQKASISAET TRAQDLVEQV KTSEQNIAKL NAMISNPDAI  (M8)
(4538)   DQHSKETALS EQKASISAET TRAQDLVEQV KTSEQNIAKL NAMISNPDAI  (M50)
(5455)   DQHSKETALS EQKASISAET TRAQDLVEQV KTSEQNIAKL NAMISNPDAI  (M62)
(5531)   DQHSKETALS EQKASISAET TRAQDLVEQV KTSEQNIAKL NAMINNPDAI  (M75)

(3776)   DQHSKETALS EQKASISAET TRAQDLVEQV KTSEQNIAKL NAMISNPDAI  (M44)
(5481)   DQHSKETALS EQKASISAET TRAQDLVEQV KTSEQNIAKL NAMISNPDAI  (M44)

(4959)   DQHSKETALS EQKASISAET TRAQDLVEQV KTSEQNIAKL NAMISNPDAI  (M77)
(D2071)  DQHSKETALS EQKASISAET TRAQDLVEQV KTSEQNIAKL NAMISNPDAI  (M23)
(4436)   DQHSKETALS EQKASISAET TRAQDLVEQV KTSEQNIAKL NAMISNPDAI  (M28)
(2727)   DQHSKETALS EQKASISAET TRAQDLVEQV KTSEQNIAKL NAMISNPDAI  (M11)
(2719)   DQHSKETALS EQKASISAET TRAQDLVEQV KTSEQNIAKL NAMISNPDAI  (M?)
(3789)   DQHSKETALS EQKASISAET TRAQDLVEQV KTSEQNIAKL NAMISNPDAI  (M78)
(5476)   DQHSKETALS EQKASISAET TRAQDLVEQV KTSEQNIAKL NAMISNPDAI  (M89)
(4088)   DQHSKETALS EQKASISAET TRAQDLVEQV KTSEQNIAKL NAMISNPDAI  (M?)

(MANFR)  DQHSKETALS EQKASISAET TRAQDLVEQV KTSEQNIAKL NAMISNPDAI  (M5)
(M8232)  DQHSKETALS EQKASISVET TRAQDLVEQV KTSEQNIAKL NAMISNPDAI  (M18)
(M315)   DQHSKETALS EQKASISAET TRAQDLVEQV KTSEQNIAKL NAMISNPDAI  (M3)
(SS1)    DQHSKETALS EQKASISAET TRAQDLVEQV KTSEQNIAKL NAMISNPDAI  (M3)
```

FIG. 1E

```
              201                                                       250
(SF370)   TKAAQTANDN TKALSSELEK AKADLENQKA KVKKQLTEEL AAQKAALAEK (M1)
(2634)    TKAAQTANDN TKALSSELEK AKADLENQKA KVKKQLTEEL AAQKAALAEK (M1)
(2580)    TKAAQTANDN TKALSSELEK AKADLENQKA KVKKQLTEEL AAQKAALAEK (M1)
(3280)    TKAAQTANDN TKALSSELEK AKADLENQKA KVKKQLTEEL AAQKAALAEK (M1)
(3348)    TKAAQTANDN TKALSSELEK AKADLENQKA KVKKQLTEEL AAQKAALAEK (M1)
(2913)    TKAAQTANDN TKALSSELEK AKADLENQKA KVKKQLTEEL AAQKAALAEK (M1)

(2726)    TKAAQTANDN TKALSSELEK AKADLENQKA KVKKQLTEEL AAQKAALAEK (M2)

(2721)    TKAAQTANDN TKALSSELEK AKADLENQKA KVKKQLTEEL AAQKAALAEK (M3)
(3040)    TKAAQTANDN TKALSSELEK AKADLENQKA KVKKQLTEEL AAQKAALAEK (M3)
(3135)    TKAAQTANDN TKALSSELEK AKADLENQKA KVKKQLTEEL AAQKAALAEK (M3)

(2722)    TKAAQTANDN TKALSSELEK AKADLENQKA KVKKQLTEEL AAQKAALAEK (M4)
(2728)    TKAAQTANDN TKALSSELEK AKADLENQKA KVKKQLTEEL AAQKAALAEK (M4)

(4883)    TKAAQTANDN TKALSSELEK AKADLENQKA KVKKQLTEEL AAQKAALAEK (M5)

(2724)    TKAAQTANDN TKALSSELEK AKADLENQKA KVKKQLTEEL AAQKAALAEK (M6)
(2894)    TKAAQTANDN TKALSSELEK AKADLENQKA KVKKQLTEEL AAQKAALAEK (M6)
(3650)    TKAAQTANDN TKALSSELEK AKADLENQKA KVKKQLTEEL AAQKAALAEK (M6)
(5529)    TKAAQTANDN TKALSSELEK AKADLENQKA KVKKQLTEEL AAQKAALAEK (M6)

(2720)    TKAAQTANDN TKALSSELEK AKADLENQKA KVKKQLTEEL AAQKAALAEK (M9)
(2725)    TKAAQTANDN TKALSSELEK AKADLENQKA KVKKQLTEEL AAQKAALAEK (M8)
(4538)    TKAAQTANDN TKALSSELEK AKADLENQKA KVKKQLTEEL AAQKAALAEK (M50)
(5455)    TKAAQTANDN TKALSSELEK AKADLENQKA KVKKQLTEEL AAQKAALAEK (M62)
(5531)    TKAAQTANDN TKALSSELEK AKADLENQKA KVKKQLTEEL AAQKAALAEK (M75)

(3776)    TKAAQTANDN TKALSSELEK AKADLENQKA KVKKQLTEEL AAQKAALAEK (M44)
(5481)    TKAAQTANDN TKALSSELEK AKADLENQKA KVKKQLTEEL AAQKAALAEK (M44)

(4959)    TKAAQTANDN TKALSSELEK AKADLENQKA KVKKQLTEEL AAQKAALAEK (M77)
(D2071)   TKAAQTANDN TKALSSELEK AKADLENQKA KVKKQLTEEL AAQKAALAEK (M23)
(4436)    TKAAQTANDN TKALSSELEK AKADLENQKA KVKKQLTEEL AAQKAALAEK (M28)
(2727)    TKAAQTANDN TKALSSELEK AKADLENQKA KVKKQLTEEL AAQKAALAEK (M11)
(2719)    TKAAQTANDN TKALSSELEK AKADLENQKA KVKKQLTEEL AAQKAALAEK (M?)
(3789)    TKAAQTANDN TKALSSELEK AKADLENQKA KVKKQLTEEL AAQKAALAEK (M78)
(5476)    TKAAQTANDN TKALSSELEK AKADLENQKA KVKKQLTEEL AAQKAALAEK (M89)
(4088)    TKAAQTANDN TKALSSELEK AKADLENQKA KVKKQLTEEL AAQKAALAEK (M?)

(MANFR)   TKAAQTANDN TKALSSELEK AKADLENQKA KVKKQLTEEL AAQKAALAEK (M5)
(M8232)   TKAAQTANDN TKALSSELEK AKADLENQKA KVKKQLTEEL AAQKAALAEK (M18)
(M315)    TKAAQTANDN TKALSSELEK AKADLENQKA KVKKQLTEEL AAQKAALAEK (M3)
(SS1)     TKAAQTANDN TKALSSELEK AKADLENQKA KVKKQLTEEL AAQKAALAEK (M3)
```

```
FIG. 1F
           251                                                    300
(SF370)    EAELSRLKSS APSTQDSIVG NNTMKAPQGY PLEELKKLEA SGYIGSASYN (M1)
(2634)     EAELSRLKSS APSTQDSIVG NNTMKAPQGY PLEELKKLEA SGYIGSASYN (M1)
(2580)     EAELSRLKSS APSTQDSIVG NNTMKAPQGY PLEELKKLEA SGYIGSASYN (M1)
(3280)     EAELSRLKSS APSTQDSIVG NNTMKAPQGY PLEELKKLEA SGYIGSASYN (M1)
(3348)     EAELSRLKSS APSTQDSIVG NNTMKAPQGY PLEELKKLEA SGYIGSASYN (M1)
(2913)     EAELSRLKSS APSTQDSIVG NNTMKAPQGY PLEELKKLEA SGYIGSASYN (M1)

(2726)     EAELSRLKSS APSTQDSIVG TNTMKAPQGY PLEELKKLEA SGYIGSASYN (M2)

(2721)     EAELSRLKSS APSTQDSIVG NNTMKAPQGY PLEELKKLEA SGYIGSASYN (M3)
(3040)     EAELSRLKSS APSTQDSIVG NNTMKAPQGY PLEELKKLEA SGYIGSASYN (M3)
(3135)     EAELSRLKSS APSTQDSIVG NNTMKAPQGY PLEELKKLEA SGYIGSASYN (M3)

(2722)     EAELSRLKSS APSTQDSIVG NNTMKAPQGY PLEELKKLEA SGYIGSASYN (M4)
(2728)     EAELSRLKSS APSTQDSIVG NNTMKAPQGY PLEELKKLEA SGYIGSASYN (M4)

(4883)     EAELSRLKSS APSTQDSIVG NNTMKAPQGY PLEELKKLEA SGYIGSASYN (M5)

(2724)     EAELSRLKSS APSTQDSIVG NNTMKAPQGY PLEELKKLEA SGYIGSASYN (M6)
(2894)     EAELSRLKSS APSTQDSIVG NNTMKAPQGY PLEELKKLEA SGYIGSASYN (M6)
(3650)     EAELSRLKSS APSTQDSIVG NNTMKAPQGY PLEELKKLEA SGYIGSASYN (M6)
(5529)     EAELSRLKSS APSTQDSIVG NNTMKAPQGY PLEELKKLEA SGYIGSASYN (M6)

(2720)     EAELSRLKSS APSTQDSIVG NNTMKAPQGY PLEELKKLEA SGYIGSASYN (M9)
(2725)     EAELSRLKSS APSTQDSIVG NNTMKAPQGY PLEELKKLEA SGYIGSASYN (M8)
(4538)     EAELSRLKSS APSTQDSIVG NNTMKAPQGY PLEELKKLEA SGYIGSASYN (M50)
(5455)     EAELSRLKSS APSTQDSIVG NNTMKAPQGY PLEELKKLEA SGYIGSASYN (M62)
(5531)     EAELSRLKSS APSTQDSIVG NNTMKAPQGY PLEELKKLEA SGYIGSASYN (M75)

(3776)     EAELSRLKSS APSTQDSIVG NNTMKAPQGY PLEELKKLEA SGYIGSASYN (M44)
(5481)     EAELSRLKSS APSTQDSIVG NNTMKAPQGY PLEELKKLEA SGYIGSASYN (M44)

(4959)     EAELSRLKSS APSTQDSIVG NNTMKAPQGY PLEELKKLEA SGYIGSASYN (M77)
D2071)     EAELSRLKSS APSTQDSIVG NNTMKAPQGY PLEELKKLEA SGYIGSASYN (M23)
(4436)     EAELSRLKSS APSTQDSIVG NNTMKVPQGY PLEELKKLEA SGYIGSASYN (M28)
(2727)     EAELSRLKSS APSTQDSIVG NNTMKAPQGY PLEELKKLEA SGYIGSASYN (M11)
(2719)     EAELSRLKSS APSTQDSIVG NNTMKAPQGY PLEELKKLEA SGYIGSASYN (M?)
(3789)     EAELSRLKSS APSTQDSIVG NNTMKAPQGY PLEELKKLEA SGYIGSASYN (M78)
(5476)     EAELSRLKSS APSTQDSIVG NNTMKAPQGY PLEELKKLEA SGYIGSASYN (M89)
(4088)     EAELSRLKSS APSTQDSIVG NNTMKAPQGY PLEELKKLEA SGYIGSASYN (M?)

(MANFR)    EAELSRLKSS APSTQDSIVG NNTMKAPQGY PLEELKKLEA SGYIGSASYN (M5)
(M8232)    EAELSRLKSS APSTQDSIVG NNTMKAPQGY PLEELKKLEA SGYIGSASYN (M18)
(M315)     EAELSRLKSS APSTQDSIVG NNTMKAPQGY PLEELKKLEA SGYIGSASYN (M3)
(SS1)      EAELSRLKSS APSTQDSIVG NNTMKAPQGY PLEELKKLEA SGYIGSASYN (M3)
```

FIG. 1G

```
             301                                                          350
(SF370)   NYYKEHADQI IAKASPGNQL NQYQDIPADR NRFVDPDNLT PEVQNELAQF  (M1)
(2634)    NYYKEHADQI IAKASPGNQL NQYQDIPADR NRFVDPDNLT PEVQNELAQF  (M1)
(2580)    NYYKEHADQI IAKASPGNQL NQYQDIPADR NRFVDPDNLT PEVQNELAQF  (M1)
(3280)    NYYKEHADQI IAKASPGNQL NQYQDIPADR NRFVDPDNLT PEVQNELAQF  (M1)
(3348)    NYYKEHADQI IAKASPGNQL NQYQDIPADR NRFVDPDNLT PEVQNELAQF  (M1)
(2913)    NYYKEHADQI IAKASPGNQL NQYQDIPADR NRFVDPDNLT PEVQNELAQF  (M1)

(2726)    NYYKEHADQI IAKASPGNQL NQYQDIPADR TRFVDPDNLT PEVQNELAQF  (M2)

(2721)    NYYKEHADQI IAKASPGNQL NQYQDIPADR NRFVDPDNLT PEVQNELAQF  (M3)
(3040)    NYYKEHADQI IAKASPGNQL NQYQDIPADR NRFVDPDNLT PEVQNELAQF  (M3)
(3135)    NYYKEHADQI IAKASPGNQL NQYQDIPADR NRFVDPDNLT PEVQNELAQF  (M3)

(2722)    NYYKEHADQI IAKASPGNQL NQYQDIPADR NRFVDPDNLT PEVQNELAQF  (M4)
(2728)    NYYKEHADQI IAKASPGNQL NQYQDIPADR NRFVDPDNLT PEVQNELAQF  (M4)

(4883)    NYYKEHADQI IAKASPGNQL NQYQDIPADR NRFVDPDNLT PEVQNELAQF  (M5)

(2724)    NYYKEHADQI IAKASPGNQL NQYQDIPADR NRFVDPDNLT PEVQNELAQF  (M6)
(2894)    NYYKEHADQI IAKASPGNQL NQYQDIPADR NRFVDPDNLT PEVQNELAQF  (M6)
(3650)    NYYKEHADQI IAKASPGNQL NQYQDIPADR NRFVDPDNLT PEVQNELAQF  (M6)
(5529)    NYYKEHADQI IAKASPGNQL NQYQDIPADR NRFVDPDNLT PEVQNELAQF  (M6)

(2720)    NYYKEHADQI IAKASPGNQL NQYQDIPADR NRFVDPDNLT PEVQNELAQF  (M9)
(2725)    NYYKEHADQI IAKASPGNQL NQYQDIPADR NRFVDPDNLT PEVQNELAQF  (M8)
(4538)    NYYKEHADQI IAKASPGNQL NQYQDIPADR NRFVDPDNLT PEVQNELAQF  (M50)
(5455)    NYYKEHADQI IAKASPGNQL NQYQDIPADR NRFVDPDNLT PEVQNELAQF  (M62)
(5531)    NYYKEHADQI IAKASPGNQL NQYQDIPADR NRFVDPDNLT PEVQNELAQF  (M75)

(3776)    NYYKEHADQI IAKASPGNQL NQYQDIPADR NRFVDPDNLT PEVQNELAQF  (M44)
(5481)    NYYKEHADQI IAKASPGNQL NQYQDIPADR NRFVDPDNLT PEVQNELAQF  (M44)

(4959)    NYYKEHADQI IAKASPGNQL NQYQDIPADR NRFVDPDNLT PEVQNELAQF  (M77)
(D2071)   NYYKEHADQI IAKASPGNQL NQYQDIPADR NRFVDPDNLT PEVQNELAQF  (M23)
(4436)    NYYKEHADQI IAKASPGNQL NQYQDIPADR NRFVDPDNLT PEVQNELAQF  (M28)
(2727)    NYYKEHADQI IAKASPGNQL NQYQDIPADR NRFVDPDNLT PEVQNELAQF  (M11)
(2719)    NYYKEHADQI IAKASPGNQL NQYQDIPADR NRFVDPDNLT PEVQNELAQF  (M?)
(3789)    NYYKEHADQI IAKASPGNQL NQYQDIPADR NRFVDPDNLT PEVQNELAQF  (M78)
(5476)    NYYKEHADQI IAKASPGNQL NQYQDIPADR NRFVDPDNLT PEVQNELAQF  (M89)
(4088)    NYYKEHADQI IAKASPGNQL NQYQDIPADR NRFVDPDNLT PEVQNELAQF  (M?)

(MANFR)   NYYKEHADQI IAKASPGNQL NQYQDIPADR NRFVDPDNLT PEVQNELAQF  (M5)
(M8232)   NYYKEHADQI IAKASPGNQL NQYQDIPADR NRFVDPDNLT PEVQNELAQF  (M18)
(M315)    NYYKEHADQI IAKASPGNQL NQYQDIPADR NRFVDPDNLT PEVQNELAQF  (M3)
(SS1)     NYYKEHADQI IAKASPGNQL NQYQDIPADR NRFVDPDNLT PEVQNELAQF  (M3)
```

FIG. 1H
```
            351                                                          400
(SF370)  AAHMINSVRR QLGLPPVTVT AGSQEFARLL STSYKKTHGN TRPSFVYGQP (M1)
(2634)   AAHMINSVRR QLGLPPVTVT AGSQEFARLL STSYKKTHGN TRPSFVYGQP (M1)
(2580)   AAHMINSVRR QLGLPPVTVT AGSQEFARLL STSYKKTHGN TRPSFVYGQP (M1)
(3280)   AAHMINSVRR QLGLPPVTVT AGSQEFARLL STSYKKTHGN TRPSFVYGQP (M1)
(3348)   AAHMINSVRR QLGLPPVTVT AGSQEFARLL STSYKKTHGN TRPSFVYGQP (M1)
(2913)   AAHMINSVRR QLGLPPVTVT AGSQEFARLL STSYKKTHGN TRPSFVYGQP (M1)

(2726)   AAHMINSVRR QLGLPPVTVT AGSQEFARLL STSYKKTHGN TRPSFVYGQP (M2)
(2721)   AAHMINSVRR QLGLPPVTVT AGSQEFARLL STSYKKTHGN TRPSFVYGQP (M3)

(3040)   AAHMINSVRR QLGLPPVTVT AGSQEFARLL STSYKKTHGN TRPSFVYGQP (M3)
(3135)   AAHMINSVRR QLGLPPVTVT AGSQEFARLL STSYKKTHGN TRPSFVYGQP (M3)

(2722)   AAHMINSVRR QLGLPPVTVT AGSQEFARLL STSYKKTHGN TRPSFVYGQP (M4)
(2728)   AAHMINSVRR QLGLPPVTVT AGSQEFARLL STSYKKTHGN TRPSFVYGQP (M4)

(4883)   AAHMINSVRR QLGLPPVTVT AGSQEFARLL STSYKKTHGN TRPSFVYGQP (M5)

(2724)   AAHMINSVRR QLGLPPVTVT AGSQEFARLL STSYKKTHGN TRPSFVYGQP (M6)
(2894)   AAHMINSVRR QLGLPPVTVT AGSQEFARLL STSYKKTHGN TRPSFVYGQP (M6)
(3650)   AAHMINSVRR QLGLPPVTVT AGSQEFARLL STSYKKTHGN TRPSFVYGQP (M6)
(5529)   AAHMINSVRR QLGLPPVTVT AGSQEFARLL STSYKKTHGN TRPSFVYGQP (M6)

(2720)   AAHMINSVRR QLGLPPVTVT AGSQEFARLL STSYKKTHGN TRPSFVYGQP (M9)
(2725)   AAHMINSVRR QLGLPPVTVT AGSQEFARLL STSYKKTHGN TRPSFVYGQP (M8)
(4538)   AAHMINSVRR QLGLPPVTVT AGSQEFARLL STSYKKTHGN TRPSFVYGQP (M50)
(5455)   AAHMINSVRR QLGLPPVTVT AGSQEFARLL STSYKKTHGN TRPSFVYGQP (M62)
(5531)   AAHMINSVRR QLGLPPVTVT AGSQEFARLL STSYKKTHGN TRPSFVYGQP (M75)

(3776)   AAHMINSVRR QLGLPPVTVT AGSQEFARLL STSYKKTHGN TRPSFVYGQP (M44)
(5481)   AAHMINSVRR QLGLPPVTVT AGSQEFARLL STSYKKTHGN TRPSFVYGQP (M44)

(4959)   AAHMINSVRR QLGLPPVTVT AGSQEFARLL STSYKKTHGN TRPSFVYGQP (M77)
(D2071)  AAHMINSVRR QLGLPPVTVT AGSQEFARLL STSYKKTHGN TRPSFVYGQP (M23)
(4436)   AAHMINSVRR QLGLPPVTVT AGSQEFARLL STSYKKTHGN TRPSFVYGQP (M28)
(2727)   AAHMINSVRR QLGLPPVTVT AGSQEFARLL STSYKKTHGN TRPSFVYGQP (M11)
(2719)   AAHMINSVRR QLGLPPVTVT AGSQEFARLL STSYKKTHGN TRPSFVYGQP (M?)
(3789)   AAHMINSVRR QLGLPPVTVT AGSQEFARLL STSYKKTHGN TRPSFVYGQP (M78)
(5476)   AAHMINSVRR QLGLPPVTVT AGSQEFARLL STSYKKTHGN TRPSFVYGQP (M89)
(4088)   AAHMINSVRR QLGLPPVTVT AGSQEFARLL STSYKKTHGN TRPSFVYGQP (M?)

(MANFR)  AAHMINSVRR QLGLPPVTVT AGSQEFARLL STSYKKTHGN TRPSFVYGQP (M5)
(M8232)  AAHMINSVRR QLGLPPVTVT AGSQEFARLL STSYKKTHGN TRPSFVYGQP (M18)
(M315)   AAHMINSVRR QLGLPPVTVT AGSQEFARLL STSYKKTHGN TRPSFVYGQP (M3)
(SS1)    AAHMINSVRR QLGLPPVTVT AGSQEFARLL STSYKKTHGN TRPSFVYGQP (M3)
```

FIG. 1I
```
         401                                                    450
(SF370)  GVSGHYGVGP HDKTIIEDSA GASGLIRNDD NMYENIGAFN DVHTVNGIKR  (M1)
(2634)   GVSGHYGVGP HDKTIIEDSA GASGLIRNDD NMYENIGAFN DVHTVNGIKR  (M1)
(2580)   GVSGHYGVGP HDKTIIEDSA GASGLIRNDD NMYENIGAFN DVHTVNGIKR  (M1)
(3280)   GVSGHYGVGP HDKTIIEDSA GASGLIRNDD NMYENIGAFN DVHTVNGIKR  (M1)
(3348)   GVSGHYGVGP HDKTIIEDSA GASGLIRNDD NMYENIGAFN DVHTVNGIKR  (M1)
(2913)   GVSGHYGVGP HDKTIIEDSA GASGLIRNDD NMYENIGAFN DVHTVNGIKR  (M1)

(2726)   GASGHYGVGP HDKTIIEDSA GASGLIRNDD NMYENIGAFN DVHTVNGIKR  (M2)

(2721)   GVSGHYGVGP HDKTIIEDSA GASGLIRNDD NMYENIGAFN DVHTVNGIKR  (M3)
(3040)   GVSGHYGVGP HDKTIIEDSA GASGLIRNDD NMYENIGAFN DVHTVNGIKR  (M3)
(3135)   GVSGHYGVGP HDKTIIEDSA GASGLIRNDD NMYENIGAFN DVHTVNGIKR  (M3)

(2722)   GVSGHYGVGP HDKTIIEDSA GASGLIRNDD NMYENIGAFN DVHTVNGIKR  (M4)
(2728)   GVSGHYGVGP HDKTIIEDSA GASGLIRNDD NMYENIGAFN DVHTVNGIKR  (M4)

(4883)   GVSGHYGVGP HDKTIIEDSA GASGLIRNDD NMYENIGAFN DVHTVNGIKR  (M5)

(2724)   GVSGHYGVGP HDKTIIEDSA GASGLIRNDD NMYENIGAFN DVHTVNGIKR  (M6)
(2894)   GVSGHYGVGP HDKTIIEDSA GASGLIRNDD NMYENIGAFN DVHTVNGIKR  (M6)
(3650)   GVSGHYGVGP HDKTIIEDSA GASGLIRNDD NMYENIGAFN DVHTVNGIKR  (M6)
(5529)   GVSGHYGVGP HDKTIIEDSA GASGLIRNDD NMYENIGAFN DVHTVNGIKR  (M6)

(2720)   GVSGHYGVGP HDKTIIEDSA GASGLIRNDD NMYENIGAFN DVHTVNGIKR  (M9)
(2725)   GVSGHYGVGP HDKTIIEDSA GASGLIRNDD NMYENIGAFN DVHTVNGIKR  (M8)
(4538)   GVSGHYGVGP HDKTIIEDSA GASGLIRNDD NMYENIGAFN DVHTVNGIKR  (M50)
(5455)   GVSGHYGVGP HDKTIIEDSA GASGLIRNDD NMYENIGAFN DVHTVNGIKR  (M62)
(5531)   GVSGHYGVGP HDKTIIEDSA GASGLIRNDD NMYENIGAFN DVHTVNGIKR  (M75)

(3776)   GVSGHYGVGP HDKTIIEDSA GASGLIRNDD NMYENIGAFN DVHTVNGIKR  (M44)
(5481)   GVSGHYGVGP HDKTIIEDSA GASGLIRNDD NMYENIGAFN DVHTVNGIKR  (M44)

(4959)   GVSGHYGVGP HDKTIIEDSA GASGLIRNDD NMYENIGAFN DVHTVNGIKR  (M77)
(D2071)  GVSGHYGVGP HDKTIIEDSA GASGLIRNDD NMYENIGAFN DVHTVNGIKR  (M23)
(4436)   GVSGHYGVGP HDKTIIEDSA GASGLIRNDD NMYENIGAFN DVHTVNGIKR  (M28)
(2727)   GVSGHYGVGP HDKTIIEDSA GASGLIRNDD NMYENIGAFN DVHTVNGIKR  (M11)
(2719)   GVSGHYGVGP HDKTIIEDSA GASGLIRNDD NMYENIGAFN DVHTVNGIKR  (M?)
(3789)   GVSGHYGVGP HDKTIIEDSA GASGLIRNDD NMYENIGAFN DVHTVNGIKR  (M78)
(5476)   GVSGHYGVGP HDKTIIEDSA GASGLIRNDD NMYENIGAFN DVHTVNGIKR  (M89)
(4088)   GVSGHYGVGP HDKTIIEDSA GASGLIRNDD NMYENIGAFN DVHTVNGIKR  (M?)

(MANFR)  GVSGHYGVGP HDKTIIEDSA GASGLIRNDD NMYENIGAFN DVHTVNGIKR  (M5)
(M8232)  GVSGHYGVGP HDKTIIEDSA GASGLIRNDD NMYENIGAFN DVHTVNGIKR  (M18)
(M315)   GVSGHYGVGP HDKTIIEDSA GASGLIRNDD NMYENIGAFN DVHTVNGIKR  (M3)
(SS1)    GVSGHYGVGP HDKTIIEDSA GASGLIRNDD NMYENIGAFN DVHTVNGIKR  (M3)
```

FIG. 1J
```
         451                                                   500
(SF370)  GIYDSIKYML FTDHLHGNTY GHAINFLRVD KHNPNAPVYL GFSTSNVGSL  (M1)
(2634)   GIYDSIKYML FTDHLHGNTY GHAINFLRVD KRNPNAPVYL GFSTSNVGSL  (M1)
(2580)   GIYDSIKYML FTDHLHGNTY GHAINFLRVD KHNPNAPVYL GFSTSNVGSL  (M1)
(3280)   GIYDSIKYML FTDHLHGNTY GHAINFLRVD KHNPNAPVYL GFSTSNVGSL  (M1)
(3348)   GIYDSIKYML FTDHLHGNTY GHAINFLRVD KHNPNAPVYL GFSTSNVGSL  (M1)
(2913)   GIYDSIKYML FTDHLHGNTY GHAINFLRVD KHNPNAPVYL GFSTSNVGSL  (M1)

(2726)   GIYDSIKYML FTDHLHGNTY GHAINFLRVD KHNPNAPVYL GFSTSNVGSL  (M2)

(2721)   GIYDSIKYML FTDHLHGNTY GHAINFLRVD KHNPNAPVYL GFSTSNVGSL  (M3)
(3040)   GIYDSIKYML FTDHLHGNTY GHAINFLRVD KHNPNAPVYL GFSTSNVGSL  (M3)
(3135)   GIYDSIKYML FTDHLHGNTY GHAINFLRVD KHNPNAPVYL GFSTSNVGSL  (M3)

(2722)   GIYDSIKYML FTDHLHGNTY GHAINFLRVD KRNPNAPVYL GFSTSNVGSL  (M4)
(2728)   GIYDSIKYML FTDHLHGNTY GHAINFLRVD KHNPNAPVYL GFSTSNVGSL  (M4)

(4883)   GIYDSIKYML FTDHLHGNTY GHAINFLRVD KRNPNAPVYL GFSTSNVGSL  (M5)

(2724)   GIYDSIKYML FTDHLHGNTY GHAINFLRVD KRNPNAPVYL GFSTSNVGSL  (M6)
(2894)   GIYDSIKYML FTDHLHGNTY GHAINFLRVD KRNPNAPVYL GFSTSNVGSL  (M6)
(3650)   GIYDSIKYML FTDHLHGNTY GHAINFLRVD KRNPNAPVYL GFSTSNVGSL  (M6)
(5529)   GIYDSIKYML FTDHLHGNTY GHAINFLRVD KRNPNAPVYL GFSTSNVGSL  (M6)

(2720)   GIYDSIKYML FTDHLHGNTY GHAINFLRVD KRNPNAPVYL GFSTSNVGSL  (M9)
(2725)   GIYDSIKYML FTDHLHGNTY GHAINFLRVD KRNPNAPVYL GFSTSNVGSL  (M8)
(4538)   GIYDSIKYML FTDHLHGNTY GHAINFLRVD KHNPKAPVYL GFSTSNVGSL  (M50)
(5455)   GIYDSIKYML FTDHLHGNTY GHAINFLRVD KHNPKAPVYL GFSTSNVGSL  (M62)
(5531)   GIYDSIKYML FTDHLHGNTY GHAINFLRVD KHNPKAPVYL GFSTSNVGSL  (M75)

(3776)   GIYDSIKYML FTDHLHGNTY GHAINFLRVD KRNPNAPVYL GFSTSNVGSL  (M44)
(5481)   GIYDSIKYML FTDHLHGNTY GHAINFLRVD KRNPNAPVYL GFSTSNVGSL  (M44)

(4959)   GIYDSIKYML FTDHLHGNTY GHAINFLRVD KRNPNAPVYL GFSTSNVGSL  (M77)
(D2071)  GIYDSIKYML FTDHLHGNTY GHAINFLRVD KRNPNAPVYL GFSTSNVGSL  (M23)
(4436)   GIYDSIKYML FTDHLHGNTY GHAINFLRVD KRNPNAPVYL GFSTSNVGSL  (M28)
(2727)   GIYDSIKYML FTDHLHGNTY GHAINFLRVD KRNPNAPVYL GFSTSNVGSL  (M11)
(2719)   GIYDSIKYML FTDHLHGNTY GHAINFLRVD KHNPNAPVYL GFSTSNVGSL  (M?)
(3789)   GIYDSIKYML FTDHLHGNTY GHAINFLRVD KHNPNAPVYL GFSTSNVGSL  (M78)
(5476)   GIYDSIKYML FTDHLHGNTY GHAINFLRVD KRNPNAPVYL GFSTSNVGSL  (M89)
(4088)   GIYDSIKYML FTDHLHGNTY GHAINFLRVD KRNPNAPVYL GFSTSNVGSL  (M?)

(MANFR)  GIYDSIKYML FTDHLHGNTY GHAINFLRVD KRNPNAPVYL GFSTSNVGSL  (M5)
(M8232)  GIYDSIKYML FTDHLHGNTY GHAINFLRVD KHNPKAPVYL GFSTSNVGSL  (M18)
(M315)   GIYDSIKYML FTDHLHGNTY GHAINFLRVD KHNPNAPVYL GFSTSNVGSL  (M3)
(SS1)    GIYDSIKYML FTDHLHGNTY GHAINFLRVD KHNPNAPVYL GFSTSNVGSL  (M3)
```

FIG. 1K

```
         501                                                      550
(SF370)  NEHFVMFPES NIANHQRFNK TPIKAVGSTK DYAQRVGTVS DTIAAIKGKV (M1)
(2634)   NEHFVMFPES NIANHQRFNK TPIKAVGSTK DYAQRVGTVS DTIAAIKGKV (M1)
(2580)   NEHFVMFPES NIANHQRFNK TPIKAVGSTK DYAQRVGTVS DTIAAIKGKV (M1)
(3280)   NEHFVMFPES NIANHQRFNK TPIKAVGSTK DYAQRVGTVS DTIAAIKGKV (M1)
(3348)   NEHFVMFPES NIANHQRFNK TPIKAVGSTK DYAQRVGTVS DTIAAIKGKV (M1)
(2913)   NEHFVMFPES NIANHQRFNK TPIKAVGSTK DYAQRVGTVS DTIAAIKGKV (M1)

(2726)   NEHFVMFPES NIANHQRFNK TPIKAVGSTK DYAQRVGTVS DTIAAIKGKV (M2)

(2721)   NEHFVMFPES NIANHQRFNK TPIKAVGSTK DYAQRVGTVS DTIAAIKGKV (M3)
(3040)   NEHFVMFPES NIANHQRFNK TPIKAVGSTK DYAQRVGTVS DTIAAIKGKV (M3)
(3135)   NEHFVMFPES NIANHQRFNK TPIKAVGSTK DYAQRVGTVS DTIAAIKGKV (M3)

(2722)   NEHFVMFPES NIANHQRFNK TPIKAVGSTK DYAQRVGTVS DTIAAIKGKV (M4)
(2728)   NEHFVMFPES NIANHQRFNK TPIKAVGSTK DYAQRVGTVS DTIAAIKGKV (M4)

(4883)   NEHFVMFPES NIANHQRFNK TPIKAVGSTK DYAQRVGTVS DTIAAIKGKV (M5)

(2724)   NEHFVMFPES NIANHQRFNK TPIKAVGSTK DYAQRVGTVS DTIAAIKGKV (M6)
(2894)   NEHFVMFPES NIANHQRFNK TPIKAVGSTK DYAQRVGTVS DTIAAIKGKV (M6)
(3650)   NEHFVMFPES NIANHQRFNK TPIKAVGSTK DYAQRVGTVS DTIAAIKGKV (M6)
(5529)   NEHFVMFPES NIANHQRFNK TPIKAVGSTK DYAQRVGTVS DTIAAIKGKV (M6)

(2720)   NEHFVMFPES NIANHQRFNK TPIKAVGSTK DYAQRVGTVS DTIAAIKGKV (M9)
(2725)   NEHFVMFPES NIANHQRFNK TPIKAVGSTK DYAQRVGTVS DTIAAIKGKV (M8)
(4538)   NEHFVMFPES NIANHQRFNK TPIKTVGSTK DYAQRVGTVS DTIAAIKGKV (M50)
(5455)   NEHFVMFPES NIANHQRFNK TPIKTVGSTK DYAQRVGTVS DTIAAIKGKV (M62)
(5531)   NEHFVMFPES NIANHQRFNK TPIKTVGSTK DYAQRVGTVS DTIAAIKGKV (M75)

(3776)   NEHFVMFPES NIANHQRFNK TPIKAVGSTK DYAQRVGTVS DTIAAIKGKV (M44)
(5481)   NEHFVMFPES NIANHQRFNK TPIKAVGSTK DYAQRVGTVS DTIAAIKGKV (M44)

(4959)   NEHFVMFPES NIANHQRFNK TPIKAVGSTK DYAQRVGTVS DTIAAIKGKV (M77)
(D2071)  NEHFVMFPES NIANHQRFNK TPIKAVGSTK DYAQRVGTVS DTIAAIKGKV (M23)
(4436)   NEHFVMFPES NIANHQRFNK TPIKAVGSTK DYAQRVGTVS DTIAAIKGKV (M28)
(2727)   NEHFVMFPES NIANHQRFNK TPIKAVGSTK DYAQRVSTVS DTIAAIKGKV (M11)
(2719)   NEHFVMFPES NIANHQRFNK TPIKAVGSTK DYAQRVGTVS DTIAAIKGKV (M?)
(3789)   NEHFVMFPES NIANHQRFNK TPIKAVGSTK DYAQRVGTVS DTIAAIKGKV (M78)
(5476)   NEHFVMFPES NIANHQRFNK TPIKAVGSTK DYAQRVGTVS DTIAAIKGKV (M89)
(4088)   NEHFVMFPES NIANHQRFNK TPIKAVGSTK DYAQRVSTVS DTIAAIKGKV (M?)

(MANFR)  NEHFVMFPES NIANHQRFNK TPIKAVGSTK DYAQRVGTVS DTIAAIKGKV (M5)
(M8232)  NEHFVMFPES NIANHQRFNK TPIKAVGSTK DYAQRVGTVS DTIAAIKGKV (M18)
(M315)   NEHFVMFPES NIANHQRFNK TPIKAVGSTK DYAQRVGTVS DTIAAIKGKV (M3)
(SS1)    NEHFVMFPES NIANHQRFNK TPIKAVGSTK DYAQRVGTVS DTIAAIKGKV (M3)
```

FIG. 1L

```
          551                                                    600
(SF370)   SSLENRLSAI HQEADIMAAQ AKVSQLQGKL ASTLKQSDSL NLQVRQLNDT  (M1)
(2634)    SSLENRLSAI HQEADIMAAQ AKVSQLQGKL ASTLKQSDSL NLQVRQLNDT  (M1)
(2580)    SSLENRLSAI HQEADIMAAQ AKVSQLQGKL ASTLKQSDSL NLQVRQLNDT  (M1)
(3280)    SSLENRLSAI HQEADIMAAQ AKVSQLQGKL ASTLKQSDSL NLQVRQLNDT  (M1)
(3348)    SSLENRLSAI HQEADIMAAQ AKVSQLQGKL ASTLKQSDSL NLQVRQLNDT  (M1)
(2913)    SSLENRLSAI HQEADIMAAQ AKVSQLQGKL ASTLKQSDSL NLQVRQLNDT  (M1)

(2726)    SSLENRLSAI HQEADIMAAQ AKVSQLQGKL ASTLKQSDSL NLQVRQLNDT  (M2)

(2721)    SSLENRLSAI HQEADIMAAQ AKVSQLQGKL ASTLKQSDSL NLQVRQLNDT  (M3)
(3040)    SSLENRLSAI HQEADIMAAQ AKVSQLQGKL ASTLKQSDSL NLQVRQLNDT  (M3)
(3135)    SSLENRLSAI HQEADIMAAQ AKVSQLQGKL ASTLKQSDSL NLQVRQLNDT  (M3)

(2722)    SSLENRLSAI HQEADIMAAQ AKVSQLQGKL ASTLKQSDSL NLQVRQLNDT  (M4)
(2728)    SSLENRLSAI HQEADIMAAQ AKVSQLQGKL ASTLKQSDSL NLQVRQLNDT  (M4)

(4883)    SSLENRLSAI HQEADIMAAQ AKVSQLQGKL ASTLKQSDSL NLQVRQLNDT  (M5)

(2724)    SSLENRLSAI HQEADIMAAQ AKVSQLEGKL ASTLKQSDSL NLQVRQLNDT  (M6)
(2894)    SSLENRLSAI HQEADIMAAQ AKVSQLEGKL ASTLKQSDSL NLQVRQLNDT  (M6)
(3650)    SSLENRLSAI HQEADIMAAQ AKVSQLEGKL ASTLKQSDSL NLQVRQLNDT  (M6)
(5529)    SSLENRLSAI HQEADIMAAQ AKVSQLEGKL ASTLKQSDSL NLQVRQLNDT  (M6)

(2720)    SSLENRLSAI HQEADIMAAQ AKVSQLQGKL ASTLKQSDSL NLQVRQLNDT  (M9)
(2725)    SSLENRLSAI HQEADIMAAQ AKVSQLQGKL ASTLKQSDSL NLQVRQLNDT  (M8)
(4538)    SSLENRLSAI HQEADIMAAQ AKVSQLQGKL ASTLKQSDSL NLQVRQLNDT  (M50)
(5455)    SSLENRLSAI HQEADIMAAQ AKVSQLQGKL ASTLKQSDSL NLQVRQLNDT  (M62)
(5531)    SSLENRLSAI HQEADIMAAQ AKVSQLQGKL ASTLKQSDSL NLQVRQLNDT  (M75)

(3776)    SSLENRLSAI HQEADIMAAQ AKVSQLEGKL ASTLKQSDSL NLQVRQLNDT  (M44)
(5481)    SSLENRLSAI HQEADIMAAQ AKVSQLQGKL ASTLKQSDSL NLQVRQLNDT  (M44)

(4959)    SSLENRLSAI HQEADIMAAQ AKVSQLEGKL ASTLKQSDSL NLQVRQLNDT  (M77)
(D2071)   SSLENRLSAI HQEADIMAAQ AKVSQLEGKL ASTLKQSDSL NLQVRQLNDT  (M23)
(4436)    SSLENRLSAI HQEADIMAAQ AKVSQLEGKL ASTLKQSDSL NLQVRQLNDT  (M28)
(2727)    SSLENRLSAI HQEADIMAAQ AKVSQLEGKL ASTLKQSDSL NLQVRQLNDT  (M11)
(2719)    SSLENRLSAI HQEADIMAAQ AKVSQLQGKL ASTLKQSDSL NLQVRQLNDT  (M?)
(3789)    SSLENRLSAI HQEADIMAAQ AKVSQLQGKL ASTLKQSDSL NLQVRQLNDT  (M78)
(5476)    SSLENRLSAI HQEADIMAAQ AKVSQLQGKL ASTLKQSDSL NLQVRQLNDT  (M89)
(4088)    SSLENRLSAI HQEADIMAAQ AKVSQLEGKL ASTLKQSDSL NLQVRQLNDT  (M?)

(MANFR)   SSLENRLSAI HQEADIMAAQ AKVSQLEGKL ASTLKQSDSL NLQVRQLNDT  (M5)
(M8232)   SSLENRLSAI HQEADIMAAQ AKVSQLQGKL ASTLKQSDSL NLQVRQLNDT  (M18)
(M315)    SSLENRLSAI HQEADIMAAQ AKVSQLQGKL ASTLKQSDSL NLQVRQLNDT  (M3)
(SS1)     SSLENRLSAI HQEADIMAAQ AKVSQLQGKL ASTLKQSDSL NLQVRQLNDT  (M3)
```

FIG. 1M

```
          601                                                     650
(SF370)   KGSLRTELLA AKAKQAQLEA TRDQSLAKLA SLKAALHQTE ALAEQAAARV  (M1)
(2634)    KGSLRTELLA AKAKQAQLEA TRDQSLAKLA SLKAALHQTE ALAEQAAARV  (M1)
(2580)    KGSLRTELLA AKAKQAQLEA TRDQSLAKLA SLKAALHQTE ALAEQAAARV  (M1)
(3280)    KGSLRTELLA AKAKQAQLEA TRDQSLAKLA SLKAALHQTE ALAEQAAARV  (M1)
(3348)    KGSLRTELLA AKAKQAQLEA TRDQSLAKLA SLKAALHQTE ALAEQAAARV  (M1)
(2913)    KGSLRTELLA AKAKQAQLEA TRDQSLAKLA SLKAALHQTE ALAEQAAARV  (M1)

(2726)    KGSLRTELLV AKAKQAQLEA TRDQSLAKLA SLKAAMHQTK ALAEQAAARV  (M2)

(2721)    KGSLRTELLV AKAKQAQLEA TRDQSLAKLA SLKAAMHQTK ALAEQAAARV  (M3)
(3040)    KGSLRTELLV AKAKQAQLEA TRDQSLAKLA SLKAAMHQTK ALAEQAAARV  (M3)
(3135)    KGSLRTELLV AKAKQAQLEA TRDQSLAKLA SLKAAMHQTK ALAEQAAARV  (M3)

(2722)    KGSLRTELLA AKAKQAQLEA TRDQSLAKLA SLKAALHQTE ALAEQAAARV  (M4)
(2728)    KGSLRTELLA AKAKQAQLEA TRDQSLAKLA SLKAALHQTE ALAEQAAARV  (M4)

(4883)    KGSLRTELLA AKAKQAQLEA TRDQSLAKLA SLKAALHQTE ALAEQAAARV  (M5)

(2724)    KGSLRTELLA AKAKQAQLEA TRDQSLAKLA SLKAALHQTE ALAEQAAARV  (M6)
(2894)    KGSLRTELLA AKAKQAQLEA TRDQSLAKLA SLKAALHQTE ALAEQAAARV  (M6)
(3650)    KGSLRTELLA AKAKQAQLEA TRDQSLAKLA SLKAALHQTE ALAEQAAARV  (M6)
(5529)    KGSLRTELLA AKAKQAQLEA TRDQSLAKLA SLKAALHQTE ALAEQAAARV  (M6)

(2720)    KGSLRTELLA AKAKQAQLEA TRDQSLAKLA SLKAALHQTE ALAEQAAARV  (M9)
(2725)    KGSLRTELLA AKAKQAQLEA TRDQSLAKLA SLKAALHQTE ALAEQAAARV  (M8)
(4538)    KGSLRTELLA AKAKQAQLEA TRDQSLAKLA SLKAALHQTE ALAEQAAARV  (M50)
(5455)    KGSLRTELLA AKAKQAQLEA TRDQSLAKLA SLKAALHQTE ALAEQAAARV  (M62)
(5531)    KGSLRTELLA AKAKQAQLEA TRDQSLAKLA SLKAALHQTE ALAEQAAARV  (M75)

(3776)    KGSLRTELLA AKAKQAQLEA TRDQSLAKLA SLKAALHQTE ALAEQAAARV  (M44)
(5481)    KGSLRTELLA AKAKQAQLEA TRDQSLAKLA SLKAALHQTE ALAEQAAARV  (M44)

(4959)    KGSLRTELLA AKAKQAQLEA TRDQSLAKLA SLKAALHQTE ALAEQAAARV  (M77)
(D2071)   KGSLRTELLA AKAKQAQLEA TRDQSLAKLA SLKAALHQTE ALAEQAAARV  (M23)
(4436)    KGSLRTELLA AKAKQAQLEA TRDQSLAKLA SLKAALHQTE VLAEQAAARV  (M28)
(2727)    KGSLRTELLA AKAKQAQLEA TRDQSLAKLA SLKAALHQTE ALAEQAAARV  (M11)
(2719)    KGSLRTELLA AKAKQAQLEA TRDQSLAKLA SLKAALHQTE ALAEQAAARV  (M?)
(3789)    KGSLRTELLA AKAKQAQLEA TRDQSLAKLA SLKAALHQTE ALAEQAAARV  (M78)
(5476)    KGSLRTELLA AKAKQAQLEA TRDQSLAKLA SLKAALHQTE ALAEQAAARV  (M89)
(4088)    KGSLRTELLA AKAKQAQLEA TRDQSLAKLA SLKAALHQTE ALAEQAAARV  (M?)

(MANFR)   KGSLRTELLA AKAKQAQLEA TRDQSLAKLA SLKAALHQTE ALAEQAAARV  (M5)
(M8232)   KGSLRTELLA AKAKQAQLEA TRDQSLAKLA SLKAALHQTE ALAEQAAARV  (M18)
(M315)    KGSLRTELLV AKAKQAQLEA TRDQSLAKLA SLKAAMHQTK ALAEQAAARV  (M3)
(SS1)     KGSLRTELLV AKAKQAQLEA TRDQSLAKLA SLKAAMHQTK ALAEQAAARV  (M3)
```

```
FIG. 1N
         651                                                       700
(SF370)  TALVAKKAHL QYLRDFKLNP NRLQVIRERI DNTKQDLAKT TSSLLNAQEA (M1)
(2634)   TALVAKKAHL QYLRDFKLNP NRLQVIRERI DNIKQDLAKT TSSLLNAQET (M1)
(2580)   TALVAKKAHL QYLRDFKLNP NRLQVIRERI DNTKQDLAKT TSSLLNAQEA (M1)
(3280)   TALVAKKAHL QYLRDFKLNP NRLQVIRERI DNTKQDLAKT TSSLLNAQEA (M1)
(3348)   TALVAKKAHL QYLRDFKLNP NRLQVIRERI DNTKQDLAKT TSSLLNAQEA (M1)
(2913)   TALVAKKAHL QYLRDFKLNP NRLQVIRERI DNTKQDLAKT TSSLLNAQEA (M1)

(2726)   TALVAKKAHL QYLRDFKLNP NRLQVIRERI DNTKQDLAKT TSSLLNAQET (M2)

(2721)   TALVAKKAHL QYLRDFKLNP NRLQVIRERI DNTKQDLAKT TSSLLNAQEA (M3)
(3040)   TALVAKKAHL QYLRDFKLNP NRLQVIRERI DNTKQDLAKT TSSLLNAQEA (M3)
(3135)   TALVAKKAHL QYLRDFKLNP NRLQVIRERI DNTKQDLAKT TSSLLNAQEA (M3)

(2722)   TALVAKKAHL QYLRDFKLNP NRLQVIRERI DNTKQDLAKT TSSLLNAQEA (M4)
(2728)   TALVAKKAHL QYLRDFKLNP NRLQVIRERI DNTKQDLAKT TSSLLNAQEA (M4)

(4883)   TALVAKKAHL QYLRDFKLNP NRLQVIRERI DNTKQDLAKT TSSLLNAQEA (M5)

(2724)   TALVAKKAHL QYLRDFKLNP NRLQVIRERI DNTKQDLAKT TSSLLNAQEA (M6)
(2894)   TALVAKKAHL QYLRDFKLNP NRLQVIRERI DNTKQDLAKT TSSLLNAQEA (M6)
(3650)   TALVAKKAHL QYLRDFKLNP NRLQVIRERI DNTKQDLAKT TSSLLNAQEA (M6)
(5529)   TALVAKKAHL QYLRDFKLNP NRLQVIRERI DNTKQDLAKT TSSLLNAQEA (M6)

(2720)   TALVAKKAHL QYLRDFKLNP NRLQVIRERI DNTKQDLAKT TSSLLNAQEA (M9)
(2725)   TALVAKKAHL QYLRDFKLNP NRLQVIRERI DNTKQDLAKT TSSLLNAQET (M8)
(4538)   TALVAKKAHL QYLRDFKLNP NRLQVIRERI DNTKQDLAKT TSSLLNAQET (M50)
(5455)   TALVAKKAHL QYLRDFKLNP NRLQVIRERI DNTKQDLAKT TSSLLNAQET (M62)
(5531)   TALVAKKAHL QYLRDFKLNP NRLQVIRERI DNTKQDLAKT TSSLLNAQET (M75)

(3776)   TALVAKKAHL QYLRDFKLNP NRLQVIRERI DNTKQDLAKT TSSLLNAQEA (M44)
(5481)   TALVAKKAHL QYLRDFKLNP NRLQVIRERI DNTKQDLAKT TSSLLNAQEA (M44)

(4959)   TALVAKKAHL QYLRDFKLNP NRLQVIRERI DNTKQDLAKT TSSLLNAQEA (M77)
(D2071)  TALVAKKAHL QYLRDFKLNP NRLQVIRERI DNTKQDLAKT TSSLLNAQEA (M23)
(4436)   TALVAKKAHL QYLRDFKLNP NRLQVIRERI DNTKQDLAKT TSSLLNAQET (M28)
(2727)   TALVAKKAHL QYLRDFKLNP NRLQVIRERI DNTKQDLAKT TSSLLNAQEA (M11)
(2719)   TALVAKKAHL QYLRDFKLNP NRLQVIRERI DNTKQDLAKT TSSLLNAQEA (M?)
(3789)   TALVAKKAHL QYLRDFKLNP NRLQVIRERI DNTKQDLAKT TSSLLNAQEA (M78)
(5476)   TALVAKKAHL QYLRDFKLNP NRLQVIRERI DNTKQDLAKT TSSLLNAQEA (M89)
(4088)   TALVAKKAHL QYLRDFKLNP NRLQVIRERI DNTKQDLAKT TSSLLNAQEA (M?)

(MANFR)  TALVAKKAHL QYLRDFKLNP NRLQVIRERI DNTKQDLAKT TSSLLNAQEA (M1)
(M8232)  TALVAKKAHL QYLRDFKLNP NRLQVIRERI DNTKQDLAKT TSSLLNAQEA (M1)
(M315)   TALVAKKAHL QYLRDFKLNP NRLQVIRERI DNTKQDLAKT TSSLLNAQEA (M1)
(SS1)    TALVAKKAHL QYLRDFKLNP NRLQVIRERI DNTKQDLAKT TSSLLNAQEA (M1)
```

FIG. 10

```
         701                                                    750
(SF370)  LAALQAKQSS LEATIATTEH QLTLLKTLAN EKEYRHLDED IATVPDLQVA (M1)
(2634)   LAALQAKQSS LEATIATTEH QLTLLKTLAN EKEYRHLDED IATVPDLQVA (M1)
(2580)   LAALQAKQSS LEATIATTEH QLTLLKTLAN EKEYRHLDED IATVPDLQVA (M1)
(3280)   LAALQAKQSS LEATIATTEH QLTLLKTLAN EKEYRHLDED IATVPDLQVA (M1)
(3348)   LAALQAKQSS LEATIATTEH QLTLLKTLAN EKEYRHLDED IATVPDLQVA (M1)
(2913)   LAALQAKQSS LEATIATTEH QLTLLKTLAN EKEYRHLDED IATVPDLQVA (M1)

(2726)   LAALQAKKSS LEATIATTEH QLTLLKTLAN EKEYRHLDED IATVPDLQVA (M2)

(2721)   LAALQAKQSS LEATIATTEH QLTLLKTLAN EKEYRHLDED IATVPDLQVA (M3)
(3040)   LAALQAKQSS LEATIATTEH QLTLLKTLAN EKEYRHLDED IATVPDLQVA (M3)
(3135)   LAALQAKQSS LEATIATTEH QLTLLKTLAN EKEYRHLDED IATVPDLQVA (M3)

(2722)   LAALQAKQSS LEATIATTEH QLTLLKTLAN EKEYRHLDED IATVPDLQVA (M4)
(2728)   LAALQAKQSS LEATIATTEH QLTLLKTLAN EKEYRHLDED IATVPDLQVA (M4)

(4883)   LAALQAKQSS LEATIATTEH QLTLLKTLAN EKEYRHLDED IATVPDLQVA (M5)

(2724)   LAALQAKQSS LEATIATTEH QLTLLKILAN EKEYRHLDED IATVPDLQVA (M6)
(2894)   LAALQAKQSS LEATIATTEH QLTLLKTLAN EKEYRHLDED IATVPDLQVA (M6)
(3650)   LAALQAKQSS LEATIATTEH QLTLLKTLAN EKEYRHLDED IATVPDLQVA (M6)
(5529)   LAALQAKQSS LEATIATTEH QLTLLKTLAN EKEYRHLDED IATVPDLQVA (M6)

(2720)   LAALQAKQSS LEATIATTEH QLTLLKTLAN EKEYRHLDED IATVPDLQVA (M9)
(2725)   LAALQAKQSS LEATIATTEH QLTLLKTLAN EKEYRHLDED IATVPDLQVA (M8)
(4538)   LAALQAKQSS LEATIATTEH QLTLLKTLAN EKEYRHLDED IATVPDLQVA (M50)
(5455)   LAALQAKQSS LEATIATTEH QLTLLKTLAN EKEYRHLDED IATVPDLQVA (M62)
(5531)   LAALQAKQSS LEATIATTEH QLTLLKTLAN EKEYRHLDED IATVPDLQVA (M75)

(3776)   LAALQAKQSS LEATIATTEH QLTLLKTLAN EKEYRHLDED IATVPDLQVA (M44)
(5481)   LAALQAKQSS LEATIATTEH QLTLLKTLAN EKEYRHLDED IATVPDLQVA (M44)

(4959)   LAALQAKQSS LEATIATTEH QLTLLKTLAN EKEYRHLDED IATVPDLQVA (M77)
(D2071)  LAALQAKQSS LEATIATTEH QLTLLKTLAN ENEYRHLDED IATVPDLQVA (M23)
(4436)   LAALQAKQSS LEATIATTEH QLTLLKTLAN EKGYRHLDED IATVPDLQVA (M28)
(2727)   LAALQAKQSS LEATIATTEH QLTLLKTLAN EKEYRHLDED IATVPDLQVA (M11)
(2719)   LAALQAKQSS LEATIATTEH QLTLLKTLAN EKEYRHLDED IATVPDLQVA (M?)
(3789)   LAALQAKQSS LEATIATTEH QLTLLKTLAN EKEYRHLDED IATVPDLQVA (M78)
(5476)   LAALQAKQSS LEATIATTEH QLTLLKTLAN EKEYRHLDED IATVPDLQVA (M89)
(4088)   LAALQAKQSS LEATIATTEH QLTLLKTLAN EKEYRHLDED IATVPDLQVA (M?)

(MANFR)  LAVLQAKQSS LEATIATTEH QLTLLKTLAN EKEYRHLDED IATVPDLQVA (M5)
(M8232)  LAALQAKQSS LEATIATTEH QLTLLKTLAN EKEYRHLDED IATVPDLQVA (M18)
(M315)   LAALQAKQSS LEATIATTEH QLTLLKTLAN EKEYRHLDED IATVPDLQVA (M3)
(SS1)    LAALQAKQSS LEATIATTEH QLTLLKTLAN EKEYRHLDED IATVPDLQVA (M3)
```

```
FIG. 1P
         751                                                          800
(SF370)  PPLTGVKPLS YSKIDTTPLV QEMVKETKQL LEASARLAAE NTSLVAEALV (M1)
(2634)   PPLTGVKPLS YSKIDTTPLV QEMVKETKQL LEASARLAAE NTSLVAEALV (M1)
(2580)   PPLTGVKPLS YSKIDTTPLV QEMVKETKQL LEASARLAAE NTSLVAEALV (M1)
(3280)   PPLTGVKPLS YSKIDTTPLV QEMVKETKQL LEASARLAAE NTSLVAEALV (M1)
(3348)   PPLTGVKPLS YSKIDTTPLV QEMVKETKQL LEASARLAAE NTSLVAEALV (M1)
(2913)   PPLTGVKPLS YSKIDTTPLV QEMVKETKQL LEASARLAAE NTSLVAEALV (M1)

(2726)   PPLTGVKPLS YSKIDTTPLV QEMVKETKQL LEASARLAAE NTSLVAEALV (M2)

(2721)   PSLTGVKPLS YSKVETTPLV QEMVKETKQL LEASARLAAE NTSLVAEALV (M3)
(3040)   PSLTGVKPLS YSKVETTPLV QEMVKETKQL LEASARLAAE NTSLVAEALV (M3)
(3135)   PSLTGVKPLS YSKVETTPLV QEMVKETKQL LEASARLAAE NTSLVAEALV (M3)

(2722)   PPLTGVKPLS YSKIDTTPLV QEMVKETKQL LEASARLAAE NTSLVAEALV (M4)
(2728)   PSLTGVKPLS YSKVETTPLV QEMVKETKHL LEASARLAAE NTSLVAEALV (M4)

(4883)   PPLTGVKPLS YSKIDTTPLV QEMVKETKQL LEASARLAAE NTSLVAEALV (M5)

(2724)   PPLTGVKPLS YSKIDTTPLV QEMVKETKQL LEASARLAAE NTSLVAEALV (M6)
(2894)   PPLTGVKPLS YSKIDTTPLV QEMVKETKQL LEASARLAAE NTSLVAEALV (M6)
(3650)   PPLTGVKPLS YSKIDTTPLV QEMVKETKQL LEASARLAAE NTSLVAEALV (M6)
(5529)   PPLTGVKPLS YSKIDTTPLV QEMVKETKQL LEASARLAAE NTSLVAEALV (M6)

(2720)   PPLTGVKPLS YSKIDTTPLV QEMVKETKQL LEASARLAAE NTSLVAEALV (M9)
(2725)   PSLTGVKPLS YSKIDTTPLV QEMVKETKQL LEASARLAAE NTSLVAEALV (M8)
(4538)   PPLTGVKPLS YSKIDTTPLV QEMVKETKQL LEASARLAAE NTSLVAEALV (M50)
(5455)   PPLTGVKPLS YSKIDTTPLV QEMVKETKQL LEASARLAAE NTSLVAEALV (M62)
(5531)   PPLTGVKPLS YSKIDTTPLV QEMVKETKQL LEASARLAAE NTSLVAEALV (M75)

(3776)   PPLTGVKPLS YSKIDTTPLV QEMVKETKQL LEASARLAAE NTSLVAEALV (M44)
(5481)   PPLTGVKPLS YSKIDTTPLV QEMVKETKQL LEASARLAAE NTSLVAEALV (M44)

(4959)   PPLTGVKPLS YSKIDTTPLV QEMVKETKQL LEASARLAAE NTSLVAEALV (M77)
(D2071)  PPLTGVKPLS YSKIDTTPLV QEMVKETKQL LEASARLAAE NTSLVAEALV (M23)
(4436)   PPLTGVKPLS YSKIDTTPLV QEMVKETKQL LEASARLAAE NTSLVAEALV (M28)
(2727)   PSLTGVKLLS YSKVETTPLV QEMVKETKQL LEASARLAAE NTSLVAEALV (M11)
(2719)   PPLTGVKPLS YSKIDTTPLV QEMVKETKQL LEASARLAAE NTSLVAEALV (M?)
(3789)   PPLTGVKPLS YSKIDTTPLV QEMVKETKQL LEASARLAAE NTSLVAEALV (M78)
(5476)   PSLTGVKPLS YSKVETTPLV QEMVKETKQL LEASARLAAE NTSLVAEALV (M89)
(4088)   PSLTGVKPLS YSKVETTPLV QEMVKETKQL LEASARLAAE NTSLVAEALV (M?)

(MANFR)  PPLTGVKPLS YSKIDTTPLV QEMVKETKQL LEASARLAAE NTSLVAEALV (M5)
(M8232)  PPLTGVKPLS YSKIDTTPLV QEMVKETKQL LEASARLAAE NTSLVAEALV (M18)
(M315)   PSLTGVKPLS YSKVETTPLV QEMVKETKQL LEASARLAAE NTSLVAEALV (M3)
(SS1)    PSLTGVKPLS YSKVETTPLV QEMVKETKQL LEASARLAAE NTSLVAEALV (M3)
```

FIG. 1Q

```
            801                                                    850
(SF370)  GQTSEMVASN AIVSKITSSI TQPSSKTSYG SGSSTTSNLI SDVDESTQRA (M1)
(2634)   GQTSEMVASN AIVSKITSSI TQPSSKTSYG SGSSTTSNLI SDVDESTQRA (M1)
(2580)   GQTSEMVASN AIVSKITSSI TQPSSKTSYG SGSSTTSNLI SDVDESTQRA (M1)
(3280)   GQTSEMVASN AIVSKITSSI TQPSSKTSYG SGSSTTSNLI SDVDESTQRA (M1)
(3348)   GQTSEMVASN AIVSKITSSI TQPSSKTSYG SGSSTTSNLI SDVDESTQRA (M1)
(2913)   GQTSEMVASN AIVSKITSSI TQPSSKTSYG SGSSTTSNLI SDVDESTQRA (M1)

(2726)   GQTSEMVASN AIVSKITSSI TQPSSKTSYG SGSSTTSNLI SDIDESTQRA (M2)

(2721)   GQTSEMVASN AIVSKITSSI TQPSSKTSYG SGSSTTSNLI SDVDESTQRA (M3)
(3040)   GQTSEMVASN AIVSKITSSI TQPSSKTSYG SGSSTTSNLI SDVDESTQRA (M3)
(3135)   GQTSEMVASN AIVSKITSSI TQPSSKTSYG SGSSTTSNLI SDVDESTQRA (M3)

(2722)   GQTSEMVASN AIVSKITSSI TQPSSKTSYG SGSSTTSNLI SDVDESTQRA (M4)
(2728)   GQTSEMVASN AIVSKITSSI TQPSSKTSYG SGSSTTSNLI SDVDESTQRA (M4)

(4883)   GQTSEMVASN AIVSKITSSI TQPSSKTSYG SGSSTTSNLI SDVDESTQRA (M5)

(2724)   GQTSEMVASN AIVSKITSSI TQPSSKTSYG SGSSTTSNLI SDVDESTQRA (M6)
(2894)   GQTSEMVASN AIVSKITSSI TQPSSKTSYG SGSSTTSNLI SDVDESTQRA (M6)
(3650)   GQTSEMVASN AIVSKITSSI TQPSSKTSYG SGSSTTSNLI SDVDESTQRA (M6)
(5529)   GQTSEMVASN AIVSKITSSI TQPSSKTSYG SGSSTTSNLI SDVDESTQRA (M6)

(2720)   GQTSEMVASN AIVSKITSSI TQPSSKTSYG SGSSTTSNLI SDVDESTQRA (M9)
(2725)   GQTSEMVASN AIVSKITSSI TQPSSKTSYG SGSSTTSNLI SDVDESTQRA (M8)
(4538)   GQTSEMVASN AIVSKITSSI TQPSSKTSYG SGSSTTSNLI SDVDESTQRA (M50)
(5455)   GQTSEMVASN AIVSKITSSI TQPSSKTSYG SGSSTTSNLI SDVDESTQRA (M62)
(5531)   GQTSEMVASN AIVSKITSSI TQPSSKTSYG SGSSTTSNLI SDVDESTQRA (M75)

(3776)   GQTSEMVASN AIVSKITSSI TQPSSKTSYG SGSSTTSNLI SDVDESTQRA (M44)
(5481)   GQTSEMVASN AIVSKITSSI TQPSSKTSYG SGSSTTSNLI SDVDESTQRA (M44)

(4959)   GQTSEMVASN AIVSKITSSI TQPSSKTSYG SGSSTTSNLI SDVDESTQRA (M77)
(D2071)  GQTSEMVASN AIVSKITSSI TQPSSKTSYD SGSSTTSNLI SDVDESTQRA (M23)
(4436)   GQTSEMVASN AIVSKITSSI TQPSSKTSYG SGSSTTSNLI SDVDESTQRA (M28)
(2727)   GQTSEMVASN AIVSKITSSI TQPSSKTSYG SGSSTTSNLI SDVDESTQRA (M11)
(2719)   GQTSEMVASN AIVSKITSSI TQPSSKTSYG SGSSTTSNLI SDVDESTQRA (M?)
(3789)   GQTSEMVASN AIVSKITSSI TQPSSKTSYG SGSSTTSNLI SDVDESTQRA (M78)
(5476)   GQTSEMVASN AIVSKITSSI TQPSSKTSYG SGSSTTSNLI SDVDESTQRA (M89)
(4088)   GQTSEMVASN AIVSKITSSI TQPSSKTSYG SGSSTTSNLI SDVDESTQRA (M?)

(MANFR)  GQTSEMVASN AIVSKITSSI TQPSSKTSYG SGSSTTSNLI SDVDESTQRA (M5)
(M8232)  GQTSEMVASN AIVSKITSSI TQPSSKTSYG SGSSTTSNLI SDVDESTQRA (M18)
(M315)   GQTSEMVASN AIVSKITSSI TQPSSKTSYG SGSSTTSNLI SDVDESTQRA (M3)
(SS1)    GQTSEMVASN AIVSKITSSI TQPSSKTSYG SGSSTTSNLI SDVDESTQRA (M3)
```

FIG. 1R

```
                851                    873
(SF370)  LKAGVVMLAA VGLTGFRFRK ESK  (M1)
(2634)   LKAGVVMLAA VGLTGFRFRK ESR  (M1)
(2580)   LKAGVVMLAA VGLTGFRFRK ESK  (M1)
(3280)   LKAGVVMLAA VGLTGFRFRK ESK  (M1)
(3348)   LKAGVVMLAA VGLTGFRFRK ESK  (M1)
(2913)   LKAGVVMLAA VGLTGFRFRK ESK  (M1)

(2726)   LKAGVVMLAA VGLTGVKLRK DTK  (M2)

(2721)   LKAGVVMLAA VGLTGFRFRK ESR  (M3)
(3040)   LKAGVVMLAA VGLTGFRFRK ESR  (M3)
(3135)   LKAGVVMLAA VGLTGFRFRK ESR  (M3)

(2722)   LKAGVVMLAA VGLTGFRFRK ESK  (M4)
(2728)   LKAGVVMLAA VGLTGFRFRK ESR  (M4)

(4883)   LKAGVVMLAA VGLTGFRFRK ESR  (M5)

(2724)   LKAGVVMLAA VGLTGFRFRK ESK  (M6)
(2894)   LKAGVVMLAA VGLTGFRFRK ESR  (M6)
(3650)   LKAGVVMLAA VGLTGFRFRK ESR  (M6)
(5529)   LKAGVVMLAA VGLTGFRFRK ESR  (M6)

(2720)   LKAGVVMLAA VGLTGFRFRK ESK  (M9)
(2725)   LKAGVVMLAA VGLTGFRFRK ESK  (M8)
(4538)   LKAGVVMLAA IGLTGFRFRK ESK  (M50)
(5455)   LKAGVVMLAA IGLTGFRFRK ESK  (M62)
(5531)   LKAGVVMLAA VGLTGFRFRK ESK  (M75)

(3776)   LKAGVVMLAA VGLTGFRFRK ESR  (M44)
(5481)   LKAGVVMLAA VGLTGFRFRK ESR  (M44)

(4959)   LKAGVVMLAA VGLTGFRFRK ESR  (M77)
(D2071)  LKAGVVMLAA VGLTGFRFRK ESR  (M23)
(4436)   LKAGVVMLAA VGLTGFRFRK ESK  (M28)
(2727)   LKAGVVMLAA VGLTGFRFRK ESR  (M11)
(2719)   LKAGVVMLAA VGLTGFRFRK ESK  (M?)
(3789)   LKAGVVMLAA VGLTGFRFRK ESR  (M78)
(5476)   LKAGVVMLAA VGLTGFRFRK ESK  (M89)
(4088)   LKAGVVMLAA VGLTGFRFRK ESK  (M?)

(MANFR)  LKAGVVMLAA VGLTGFRFRK ESR  (M5)
(M8232)  LKAGVVMLAA VGLTGFRFRK ESR  (M18)
(M315)   LKAGVVMLAA VGLTGFRFRK ESR  (M3)
(SS1)    LKAGVVMLAA VGLTGFRFRK ESR  (M3)
```

FIG. 4B
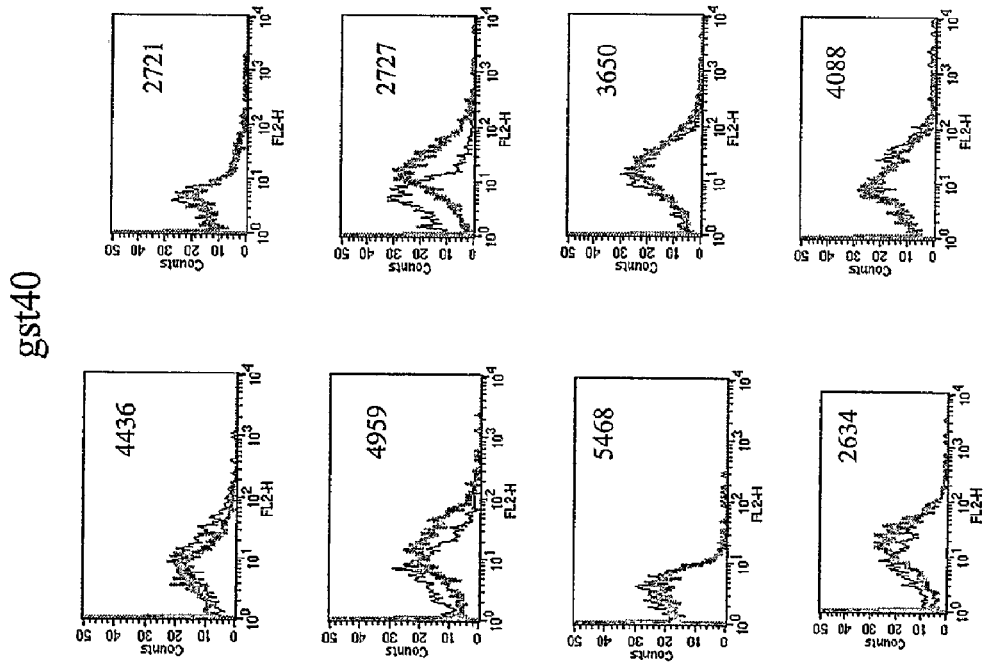
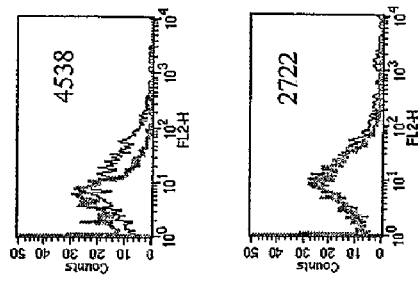

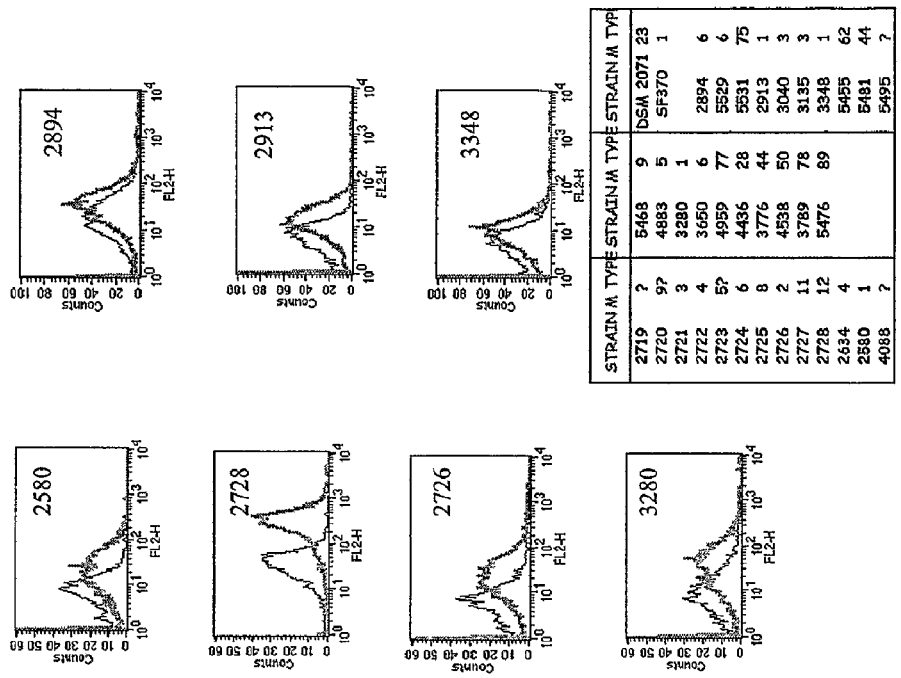
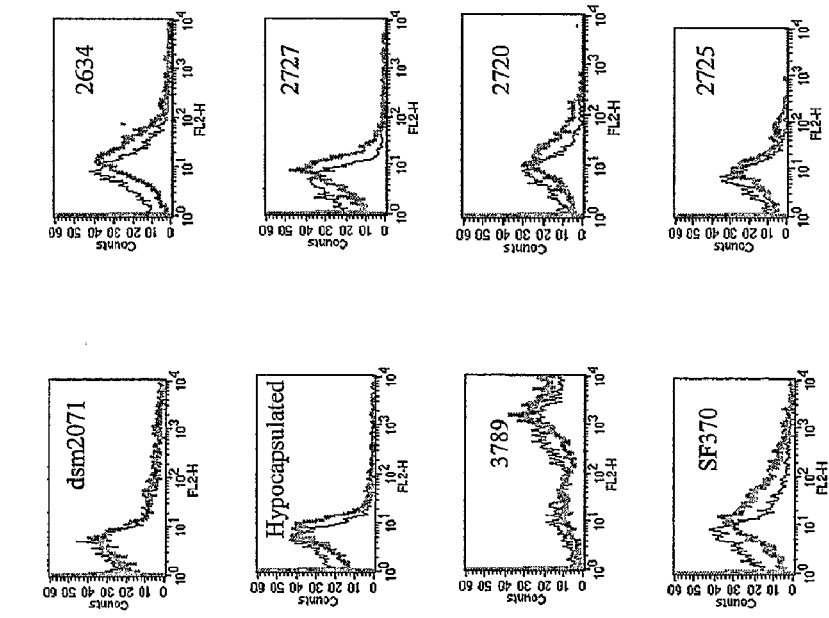
FIG. 8

40aRR

40aRR

40aNH

40aNH

40aRRNH

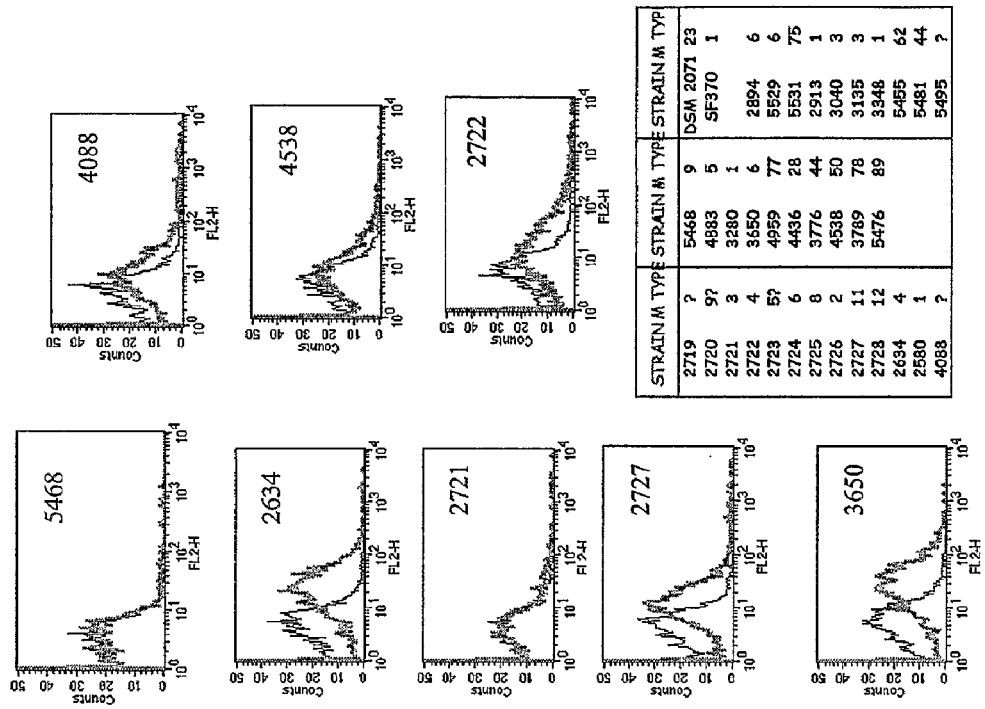
FIG. 11B, 40aRRNH

FIG. 12A
pET-21b+
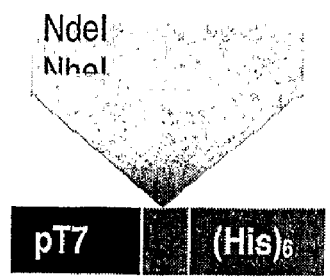
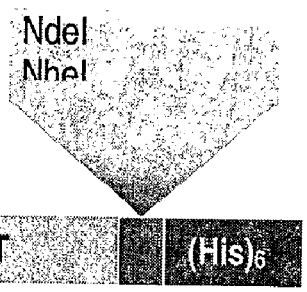
pGEX-NNH

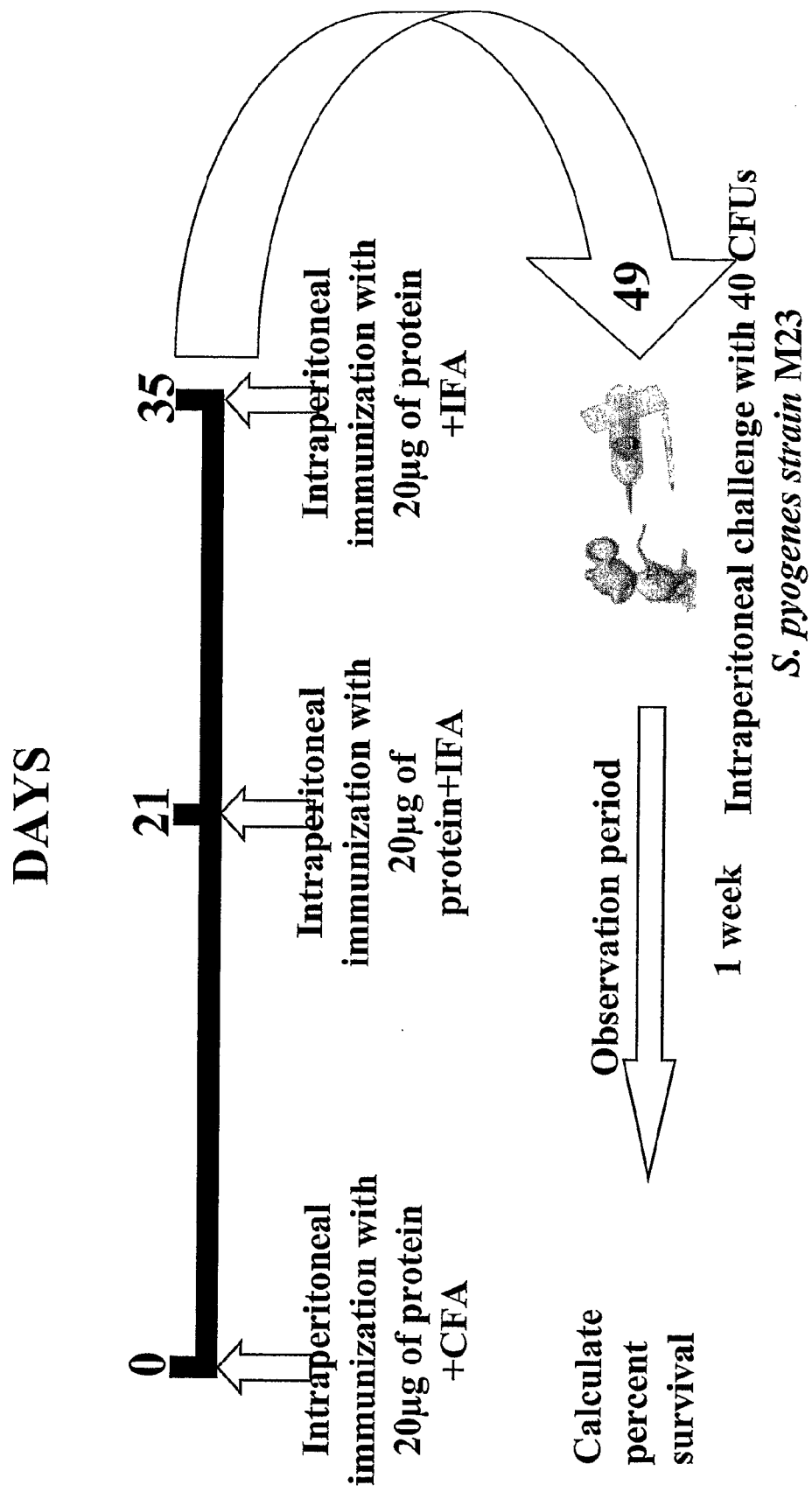
FIG. 13. Mouse Model

FIG. 14. Mouse Model Results

| Antigen | Survival (%) | p-Value |
|---|---|---|
| GAS 40 | 51 | <0.0001 |
| GAS 253 | 25 | 0.008 |
| GAS 366 | 21 | 0.046 |
| GAS 117 | 21 | 0.056 |
| GAS 504 | 22 | 0.09 |
| M homolog | 99 | |
| Negative control | 12 | |

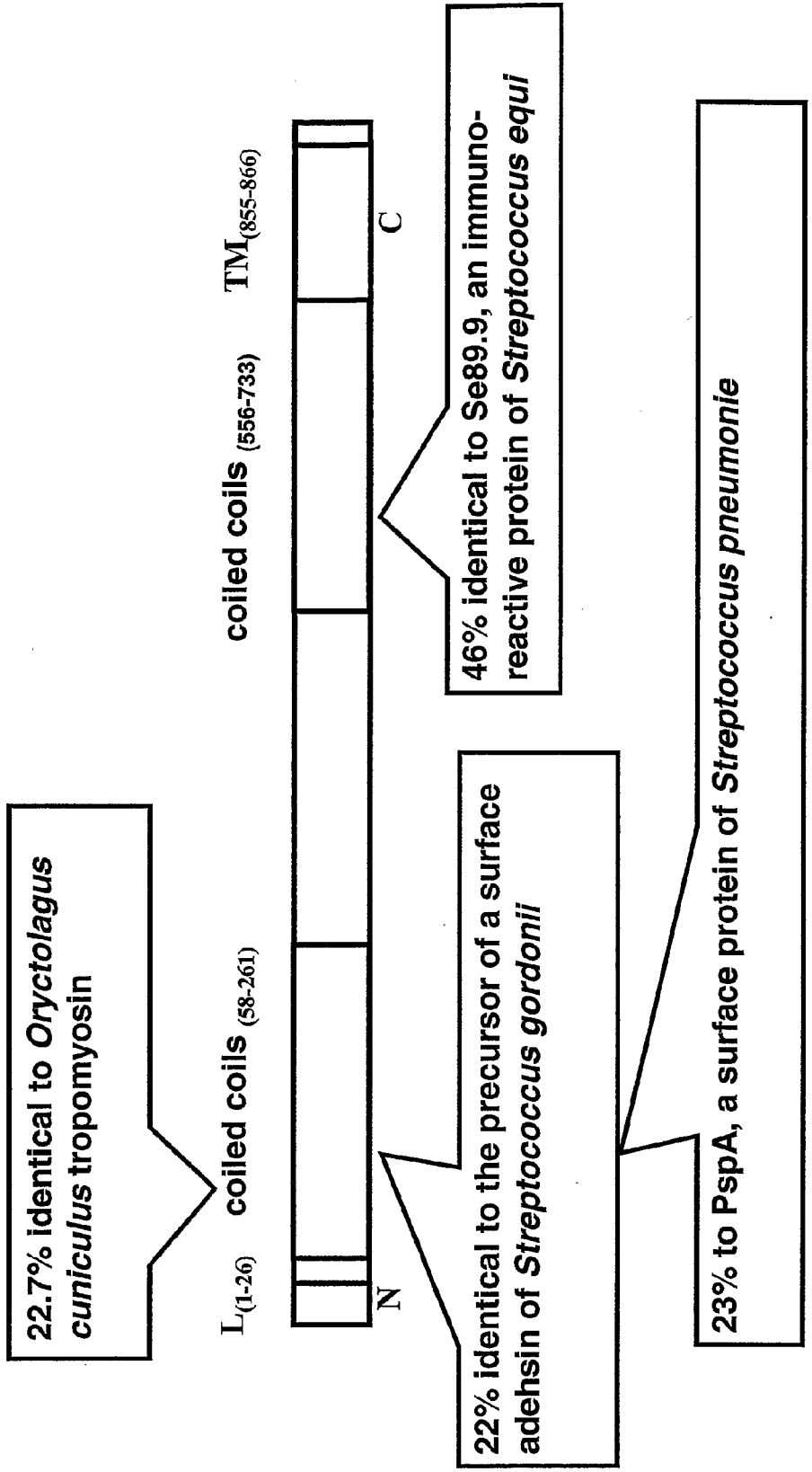
FIG. 15 Structure of GAS40

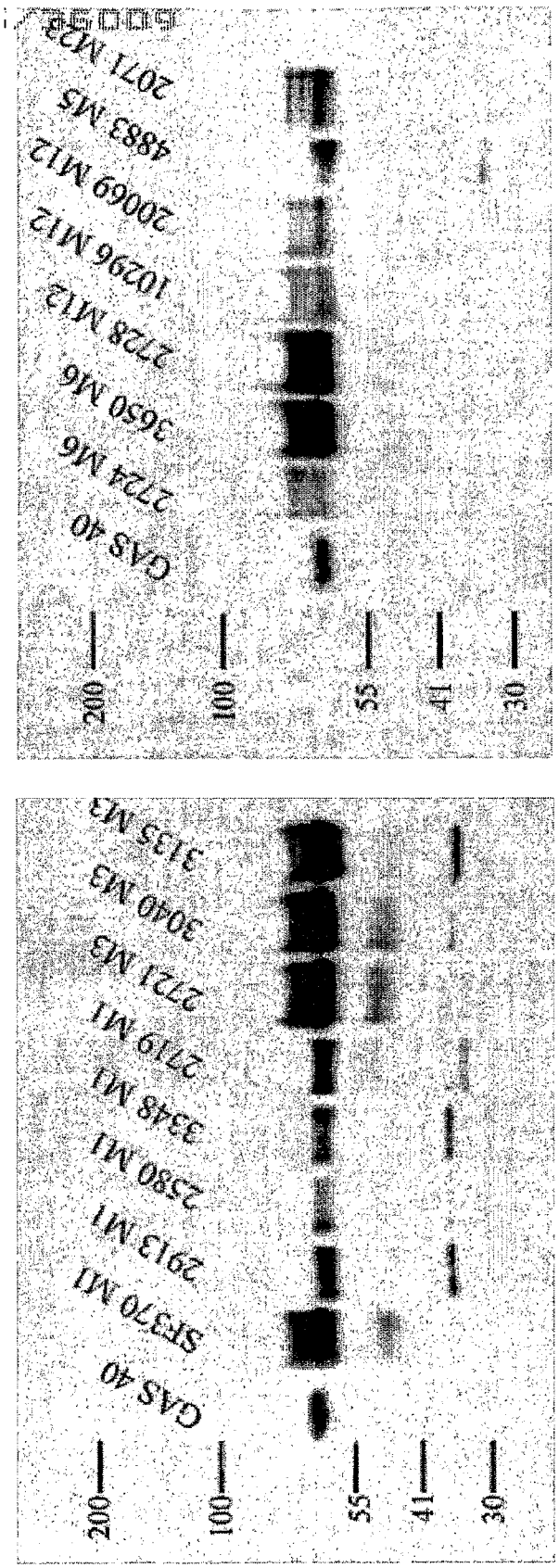
FIG. 16 Expression of GAS40 in different GAS serotypes

FIG. 17 Surface expression of GAS40
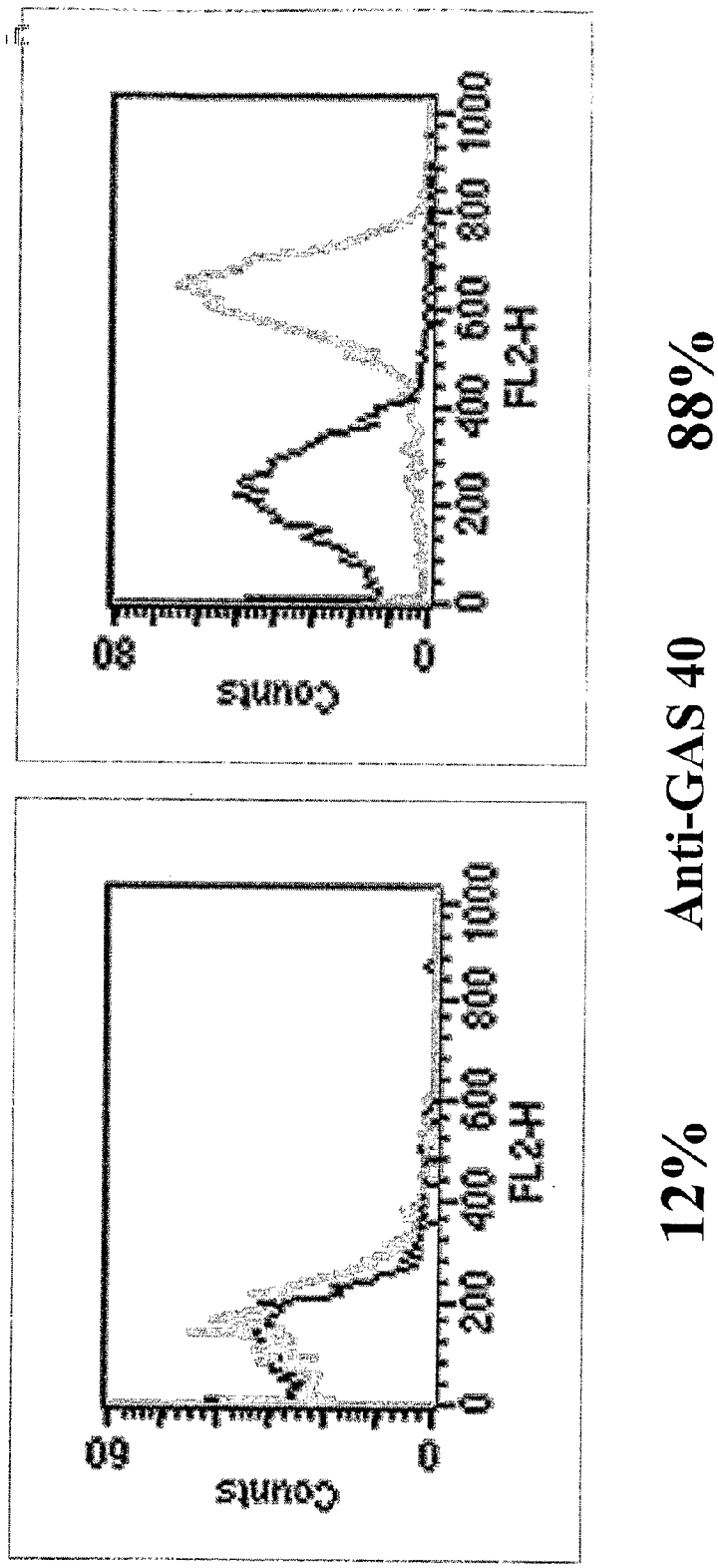

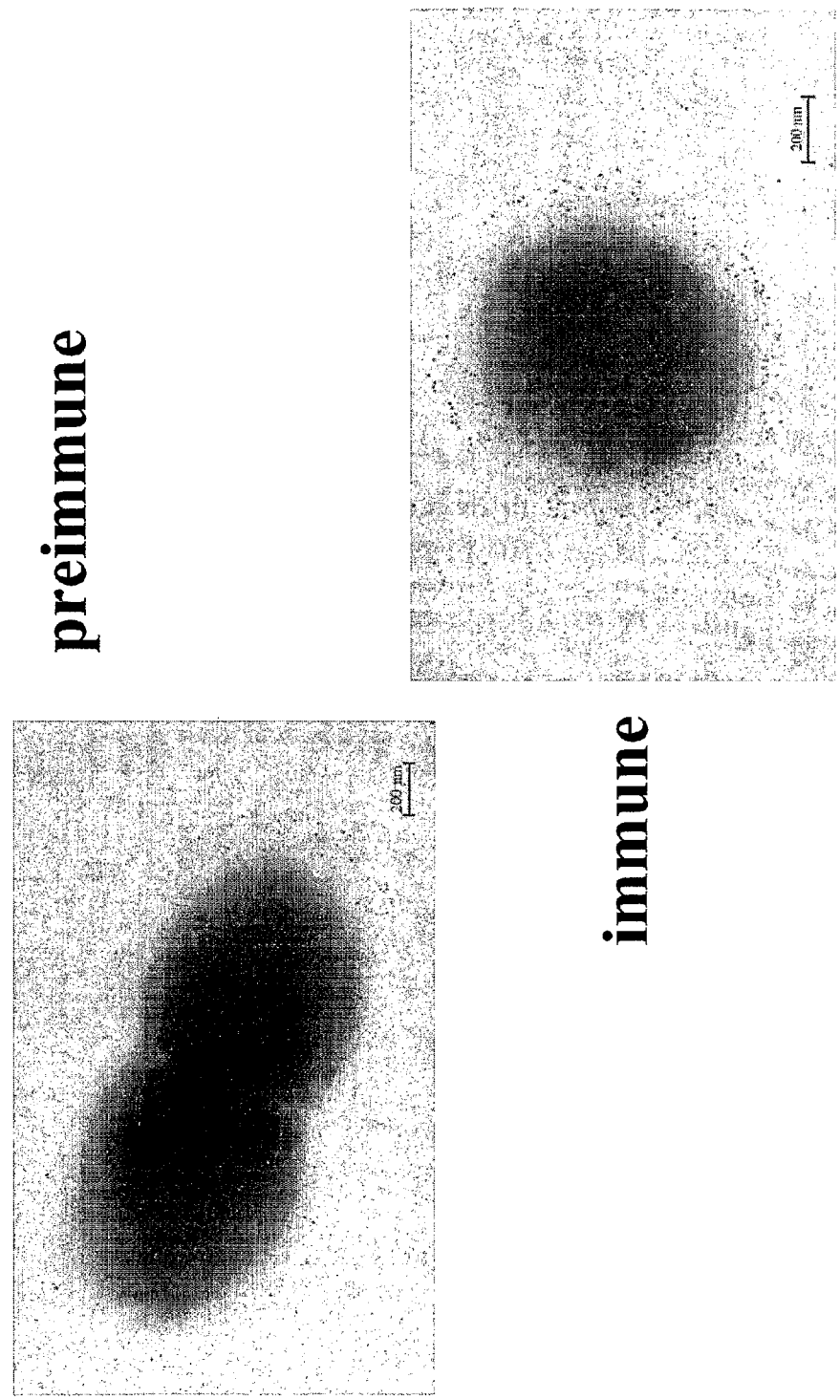
FIG. 18 Distribution of GAS40 on the bacterial surface

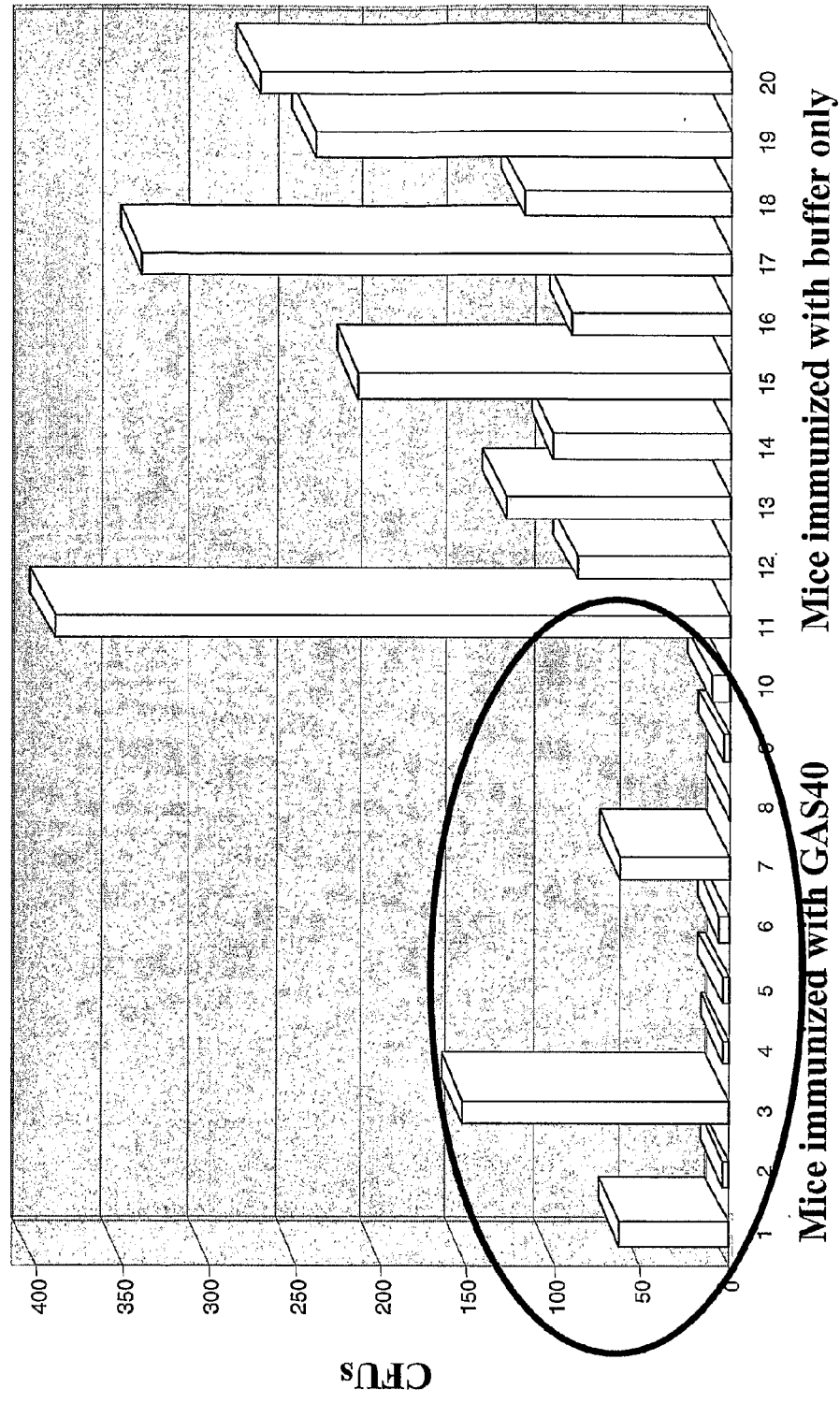
FIG. 19 Bacteriocidal properties of anti-GAS40 antibodies

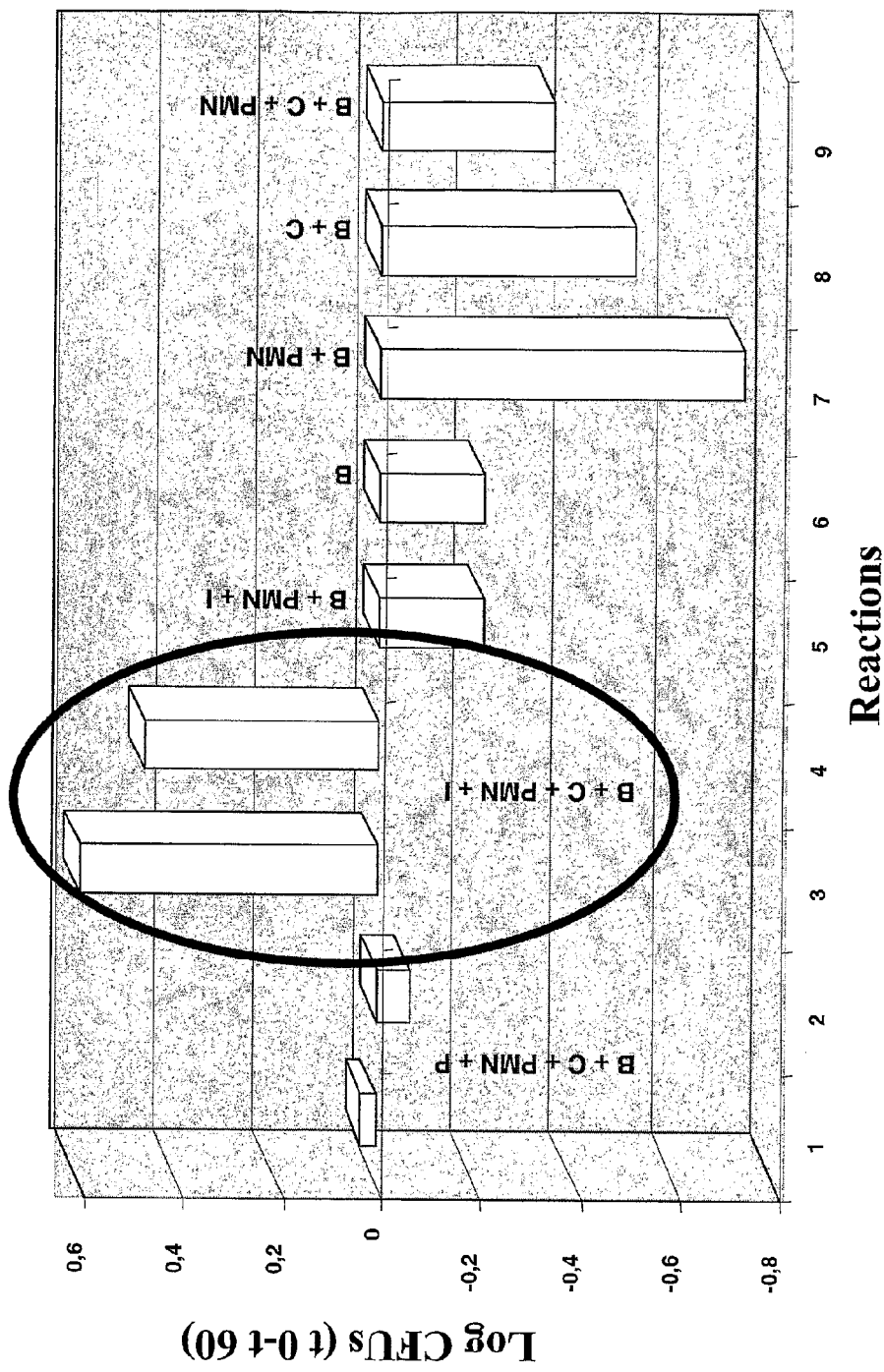
FIG. 20 Opsonization properties of anti-GAS 40 antibodies

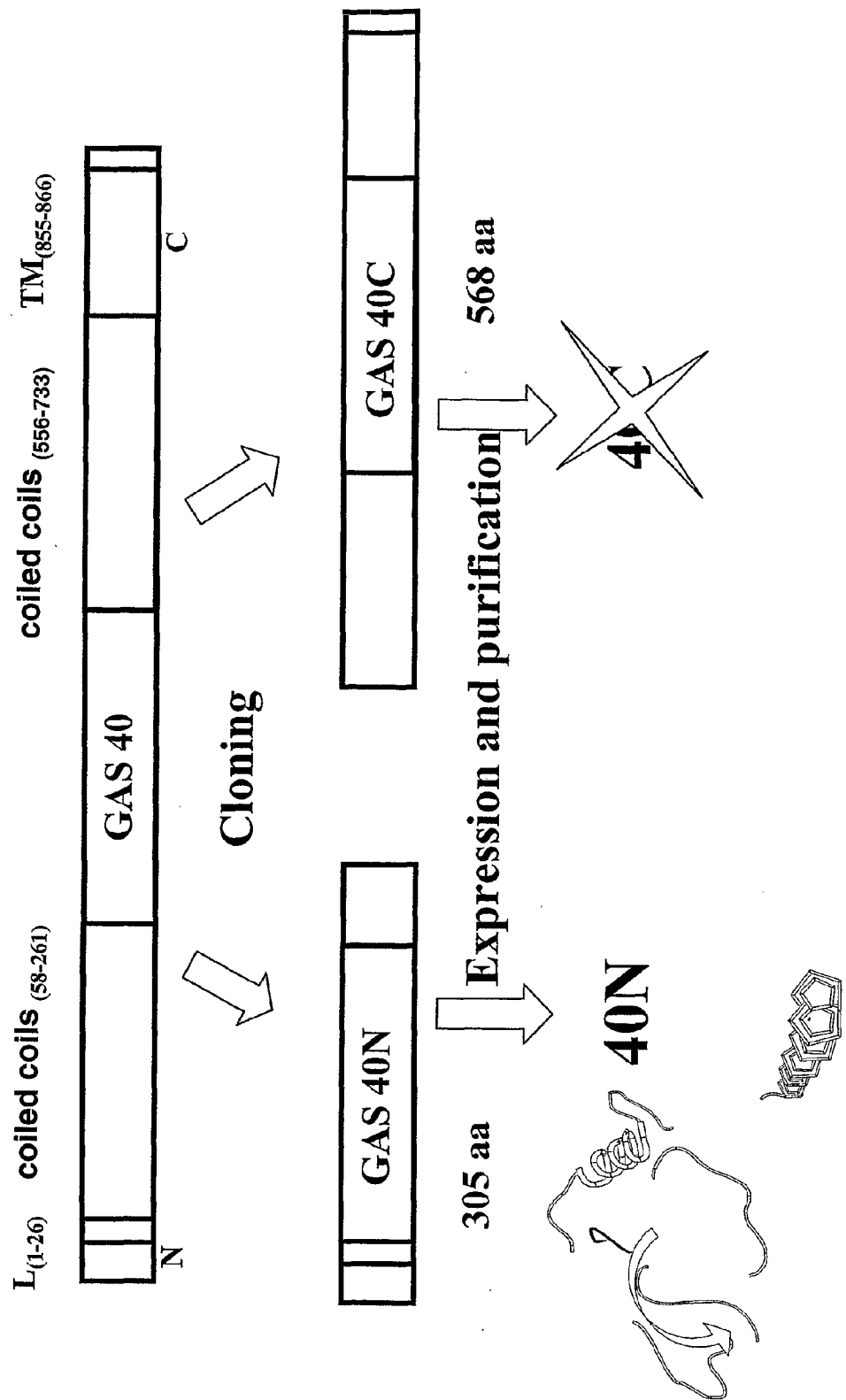
FIG. 21 GAS40 Domains

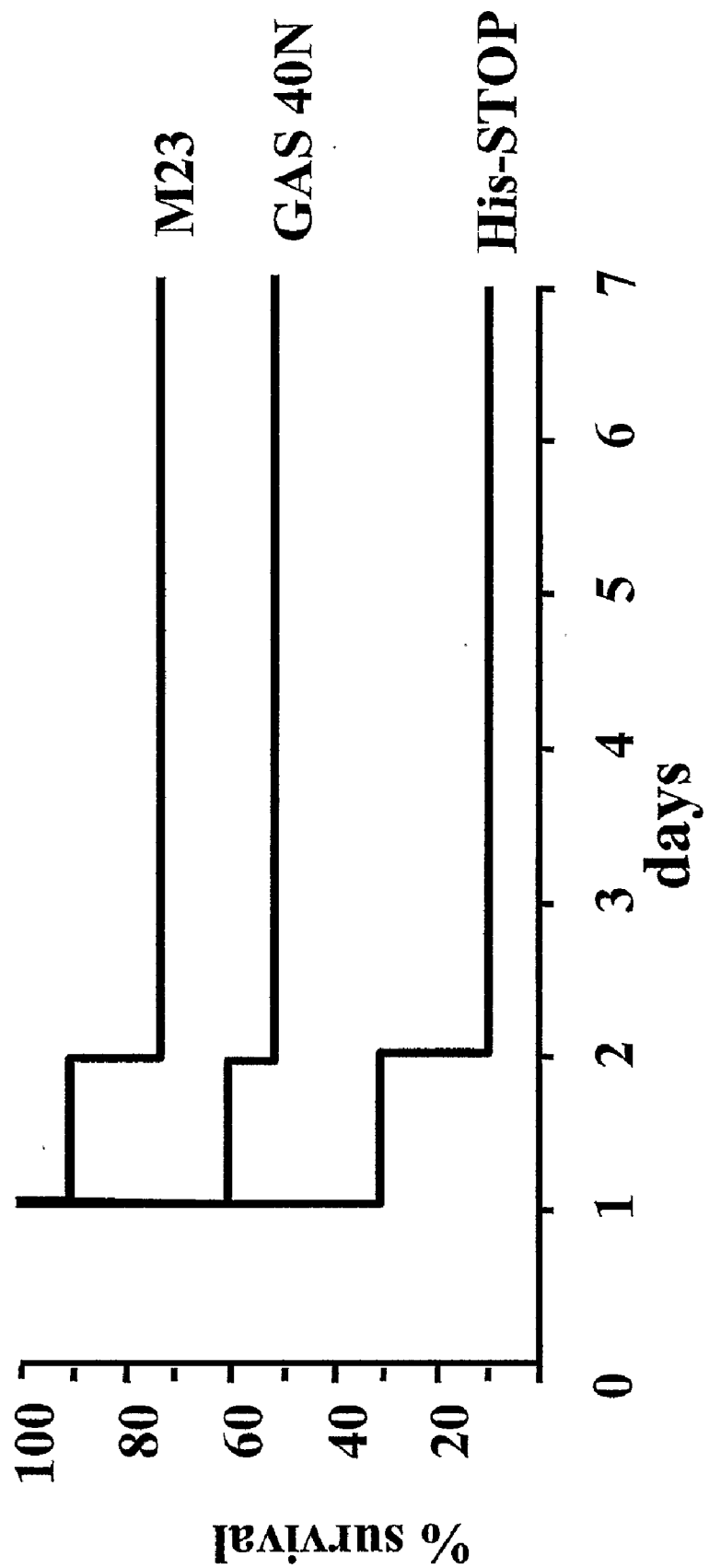
FIG. 22 GAS 40N

FIG. 23
a)
| STRAIN | SEROTYPE | ΔMean |
|---|---|---|
| SF370 | 1 | 323 |
| 3348 | 1 | 271 |
| 2726 | 2 | 400 |
| 2634 | 4 | 308 |
| 2724 | 6 | 277 |
| 2894 | 6 | 338 |
| 3650 | 6 | 322 |
| 2725 | 8 | 252 |
| 2720 | 9 | 452 |
| 2728 | 12 | 384 |
| DSM2071 | 23 | 351 |
| 4436 | 28 | 294 |
| 5529 | 6 | 220 |
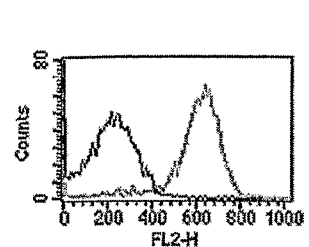
b)
| STRAIN | SEROTYPE | ΔMean |
|---|---|---|
| 2580 | 1 | 164 |
| 2913 | 1 | 89 |
| 3280 | 1 | 110 |
| 3135 | 3 | 132 |
| 2723 | 5 | 163 |
| 2727 | 11 | 89 |
| 3040 | 3 | 134 |
| 5476 | 89 | 185 |
| 5468 | 9 | 91 |
| 4883 | 5 | 83 |
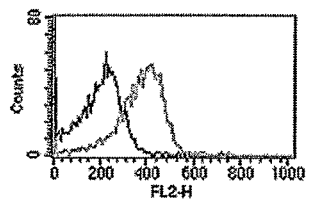
c)
| STRAIN | SEROTYPE | ΔMean |
|---|---|---|
| 2719 | 1 | 8 |
| 2721 | 3 | 8 |
| 2722 | 4 | 27 |
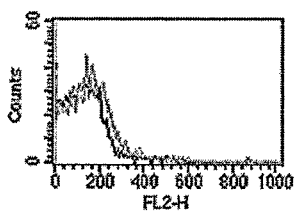

FIG. 25A

MRRAENNKHSRYSIRKLSVGVTSIAIASLFLGKVAYAVDGIPPISLTQKTTATTSENWHHIDKDGLIPLGISLEAAKEEFKKEVEESRLSEA
EAAKEEFKKEVEES LSEA                                                                      EA

QKETYKQKIKTAPDKDKLLFTYHSEYMTAVKDLPASTESTTQPVEAPVQETQASASDSMVTGDSTSVTTDSPEETPSSESPVAPALSEAPAQ
QKETYKQKIKTAPDKDK              ESTTQPVEAPVQETQ        SVTTDSPEETPSSESPVAPAL
QKETYKQKIK                      STTQPVEAPVQETQ         TDSPEETPSSESPVAPAL
KETYKQKIKTAPDKDKLLF                                      DSPEETPSSESPVAPALS
KETYKQK                                                  DSPEETPSSESPVAP
                                                          EETPSSESPVAPALSE
                                                                     LSEAPAQ
                                                                      SEAPAQ
                                                                       EAPAQ

PAESEEPSVAASSEETPSPSTPAAPETPEEPAAPSPSPESEEPSVAAPSEETPSPETPEEPAAPSQPAESEESSVAATTSPSPSTPAESETQ
PAESEEPSVA
PAESEEPSVA
PAESEEPSVA

TPPAVTKDSDKPSSAAEKPAASSLVSEQTVQQPTSKRSSDKKEEQEQSYSPNRSLSRQVRAHESGKYLPSTGEKAQPLFIATMTLMSLFGSL

LVTKRQKETKK

FIG. 26A

MRRAENNKHSRYSIRKLSVGVTSIAIASLFLGKVAYAVDGIPPISLTQKTTATTSENWHHIDKDGLIPLGISLEAAKEEFKKEVEESRLSEA
DGLIPIGISLEAAK                              VDGIPPISLTQK TATTSENWHHIDK                     LSEA
                                                                            EEFKKEVEESR

QKETYKQKIKTAPDKDKLLFTYHSEYMTAVKDLPASTESTTQPVEAPVQETQASASDSMVTGDSTSVTTDSPEETPSSESPVAPALSEAPAQ
QKETYKQK          LLFTYHSEYMTAVK
       IKTAPDKDKLLFTYHSEYMTAVK

PAESEEPSVAASSEETPSPSTPAAPETPEEPAAPSPSPESEEPSVAAPSEETPSPETPEEPAAPSQPAESEESSVAATTSPSPSTPAESETQ

TPPAVTKDSDKPSSAAEKPAASSLVSEQTVQQPTSKRSSDKKEEQEQSYSPNRSLSRQVRAHESGKYLPSTGEKAQPLFIATMTLMSLFGSL
       DSDKPSSAAEKPAASSLVSEQTVQQPTSK
       DSDKPSSAAEKPAASSLVSEQTVQQPTSKR
                                   SSDKKEEQEQSYSPNR
                                        EEQEQSYSPNR

LVTKRQKETKK

LPXTG proteins, 17 predicted

| Identified | FACS positive | FACS negative | Not Cloned |
|---|---|---|---|
| 12 | 11 | | 1 |

Membrane proteins, 506 predicted

| Identified | FACS positive | FACS negative | Not Cloned |
|---|---|---|---|
| 37 | 17 | | 15 |

Lipoproteins, 28 predicted

| Identified | FACS positive | FACS negative | Not Cloned |
|---|---|---|---|
| 11 | 9 | | 1 |

Extracellular, 67 predicted

| Identified | FACS positive | FACS negative | Not Cloned |
|---|---|---|---|
| 8 | 6 | | 1 |

Cytoplasmic

| Identified | FACS positive | FACS negative | Not Cloned |
|---|---|---|---|
| 8 | | | 8 |

GAS15, SPY NT01SP0102, FACS RESPONSE POSITIVE

GAS16, SPY 0128, FACS RESPONSE POSITIVE

FIG. 30 GAS57, SPY 0416, FACS RESPONSE POSITIVE

FIG. 31 GAS68, SPY 0737, FACS RESPONSE POSITIVE

GAS143, SPY 0747, FACS RESPONSE POSITIVE

Features: LPXTG

PSORT prediction

Signal Score (-7.5): -1.13 Possible cleavage site: 33

>>> Seems to have a cleavable N-term signal seq.

count: 1 value: -6.00 threshold: 0.0
INTEGRAL Likelihood = -6.00 Transmembrane 194 - 210 (192 - 214)
PERIPHERAL Likelihood = 8.33 modified ALOM score: 1.70

Rule: cytoplasmic membrane protein

GAS166, SPY 1357, FACS RESPONSE POSTIIVE

FIG. 34 GAS158, SPY 0843, FACS RESPONSE POSITIVE

| GAS | ORF | FACS response |
|---|---|---|
| gas171 | spy1494 | NOT CLONED |

Features: LPXTG

PSORT prediction

Signal Score (-7.5): -1.95 Possible cleavage site: 25

>>> Seems to have a cleavable N-term signal seq.

count: 1 value: -4.04 threshold: 0.0
INTEGRAL Likelihood = -4.04 Transmembrane 291 - 307 ( 290 - 309)
PERIPHERAL Likelihood = 6.47 modified ALOM score: 1.31

Rule: cytoplasmic membrane protein

GAS171, SPY 1494

Features: LPXTG

PSORT prediction

Signal Score (-7.5): 1.77 Possible cleavage site: 37
>>> Seems to have a cleavable N-term signal seq.

count: 1 value: -3.56 threshold: 0.0
INTEGRAL Likelihood = -3.56 Transmembrane 325 - 341 ( 323 - 343 )
PERIPHERAL Likelihood = 16.29 modified ALOM score: 1.21

Rule: cytoplasmic membrane protein

GAS188, SPY 1983, FACS RESPONSE
POSITIVE

GAS190, SPY 2009, FACS RESPONSE POSITIVE

GAS191, SPY 2010,
FACS RESPONSE
POSITIVE

Features: LPXTG

PSORT prediction

Signal Score (-7.5): -3.55 Possible cleavage site: 37
>>> Seems to have no N-terminal signal seq.

count: 2 value: -3.03 threshold: 0.0
INTEGRAL Likelihood = -3.03 Transmembrane 462 - 478 ( 460 - 479)
INTEGRAL Likelihood = -0.90 Transmembrane 18 - 34 ( 18 - 34)
PERIPHERAL Likelihood = 12.36 modified ALOM score: 1.11

Rule: cytoplasmic membrane protein

GAS192, SPY 2019, FACS RESPONSE POSITIVE

| GAS | Spy | FACS response |
|---|---|---|
| gas558 | spy1109 | NOT CLONED |

Features: Membrane

PSORT prediction

Signal Score (-7.5): -3.32 Possible cleavage site: 48
>>> Seems to have no N-terminal signal seq.

count: 10 value: -11.89 threshold: 0.0
INTEGRAL Likelihood =-11.89 Transmembrane 361 - 377 ( 350 - 383)
INTEGRAL Likelihood = -7.43 Transmembrane 84 - 100 ( 79 - 102)
INTEGRAL Likelihood = -6.16 Transmembrane 150 - 166 ( 137 - 171)
INTEGRAL Likelihood = -4.88 Transmembrane 30 - 46 ( 24 - 48)
INTEGRAL Likelihood = -4.35 Transmembrane 299 - 315 ( 297 - 316)
INTEGRAL Likelihood = -4.14 Transmembrane 117 - 133 ( 115 - 134)
INTEGRAL Likelihood = -3.19 Transmembrane 54 - 70 ( 51 - 75)
INTEGRAL Likelihood = -2.92 Transmembrane 425 - 441 ( 425 - 442)
INTEGRAL Likelihood = -2.81 Transmembrane 213 - 229 ( 209 - 232)
INTEGRAL Likelihood = -2.44 Transmembrane 273 - 289 ( 271 - 290)
PERIPHERAL Likelihood = 0.32 modified ALOM score: 2.88

Rule: cytoplasmic membrane protein  FIG. 41

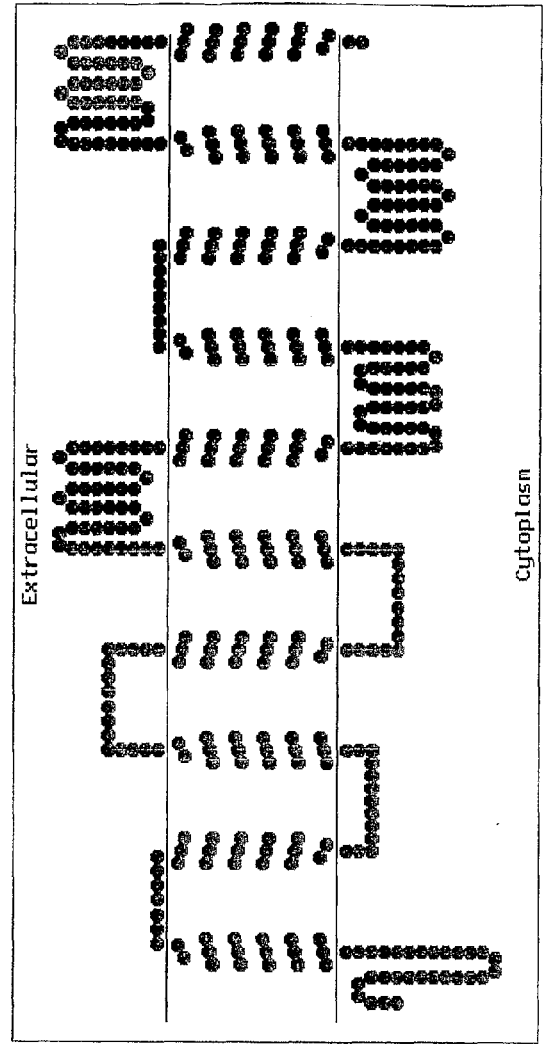

10 TM

| GAS | SPY | FACS response |
|---|---|---|
| gas460 | spy0572 | NOT CLONED |

Features: Membrane

PSORT prediction

Signal Score (-7.5): -7.23 Possible cleavage site: 20
>>> Seems to have no N-terminal signal seq.

count: 7 value: -10.40 threshold: 0.0
INTEGRAL Likelihood =-10.40 Transmembrane 246 - 262 ( 240 - 271)
INTEGRAL Likelihood = -6.26 Transmembrane 284 - 300 ( 279 - 304) INTEGRAL
Likelihood = -4.14 Transmembrane 173 - 189 ( 172 - 194) INTEGRAL Likelihood
= -3.24 Transmembrane 112 - 128 ( 111 - 137) INTEGRAL Likelihood = -2.39
Transmembrane 428 - 444 ( 425 - 445) INTEGRAL Likelihood = -2.13
Transmembrane 383 - 399 ( 380 - 401) INTEGRAL Likelihood = -1.97
Transmembrane 308 - 324 ( 304 - 327) PERIPHERAL Likelihood = 0.37 modified
ALOM score: 2.58

Rule: cytoplasmic membrane protein

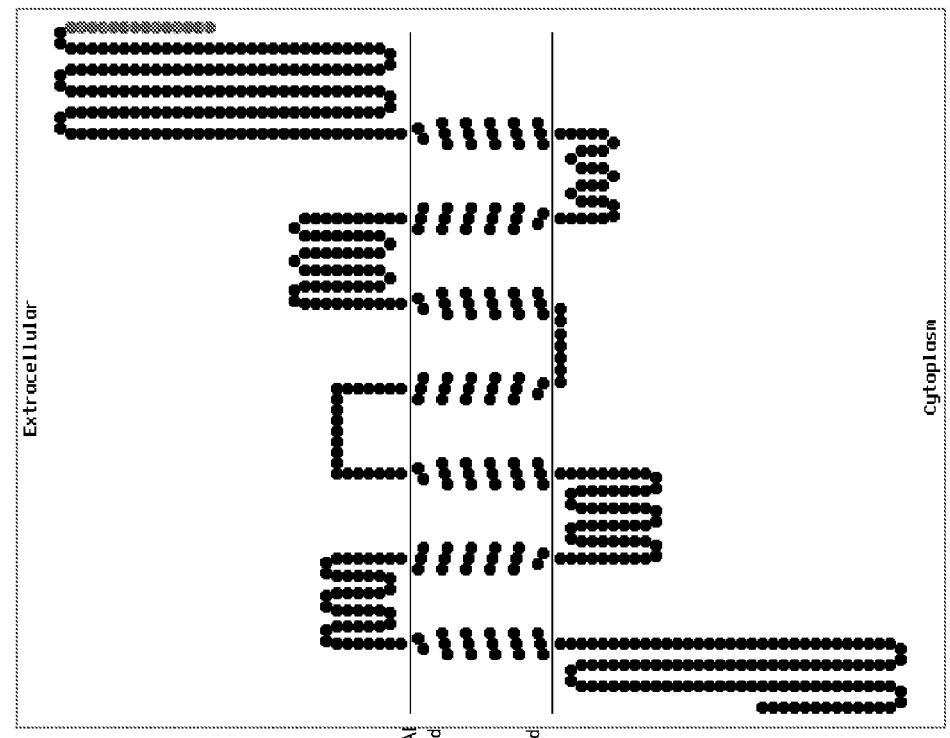

FIG. 42

Rule: cytoplasmic membrane protein
GAS425, SPY 0184, FACS RESPONSE POSITIVE

6 TM

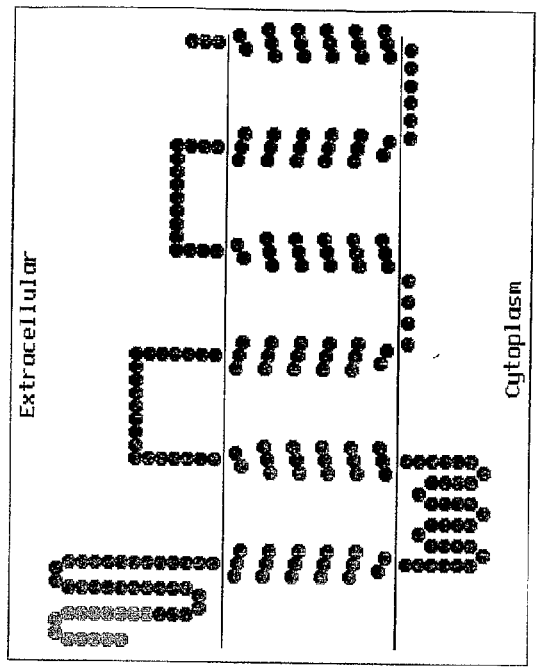

| SAG | ORF | FACS response |
|---|---|---|
| gas493 | spy0743 | NOT CLONED |

Features: Membrane

PSORT prediction

Signal Score (-7.5): -1.71 Possible cleavage site: 37
>>> Seems to have a cleavable N-term signal seq.

count: 6 value: -13.16 threshold: 0.0
INTEGRAL Likelihood =-13.16 Transmembrane 44 - 60 ( 39 - 71 )
INTEGRAL Likelihood =-10.24 Transmembrane 94 - 110 ( 81 - 114 )
INTEGRAL Likelihood = -7.64 Transmembrane 185 - 201 ( 179 - 207 )
INTEGRAL Likelihood = -7.48 Transmembrane 132 - 148 ( 130 - 158 )
INTEGRAL Likelihood = -2.76 Transmembrane 208 - 224 ( 204 - 225 )
INTEGRAL Likelihood = -0.06 Transmembrane 153 - 169 ( 152 - 169 )
PERIPHERAL Likelihood = 4.98 modified ALOM score: 3.13

Rule: cytoplasmic membrane protein

FIG. 44

| gas | orf | FACS response |
|---|---|---|
| gas469 | SPy0645 | NOT TESTED |

Features: Membrane

PSORT prediction

Signal Score (-7.5): 0.0600004 Possible cleavage site: 44
>>> Seems to have no N-terminal signal seq.

count: 4 value: -7.70 threshold: 0.0
INTEGRAL Likelihood = -7.70 Transmembrane 188 - 204 (182 - 212)
INTEGRAL Likelihood = -6.74 Transmembrane 32 - 48 (23 - 51)
INTEGRAL Likelihood = -5.52 Transmembrane 287 - 303 (281 - 307)
INTEGRAL Likelihood = -1.49 Transmembrane 239 - 255 (238 - 256)
PERIPHERAL Likelihood = 11.40 modified ALOM score: 2.04

Rule: cytoplasmic membrane protein

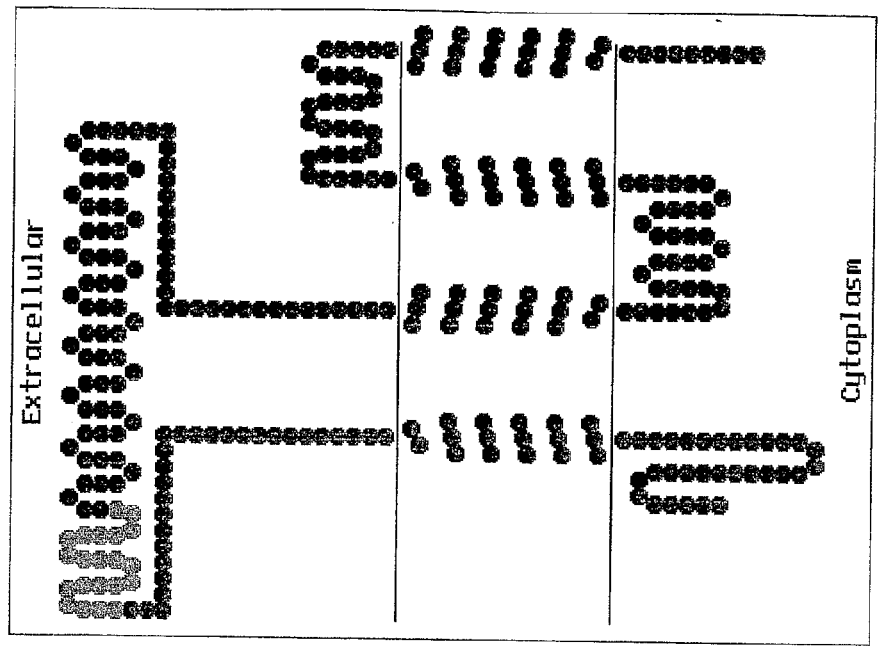

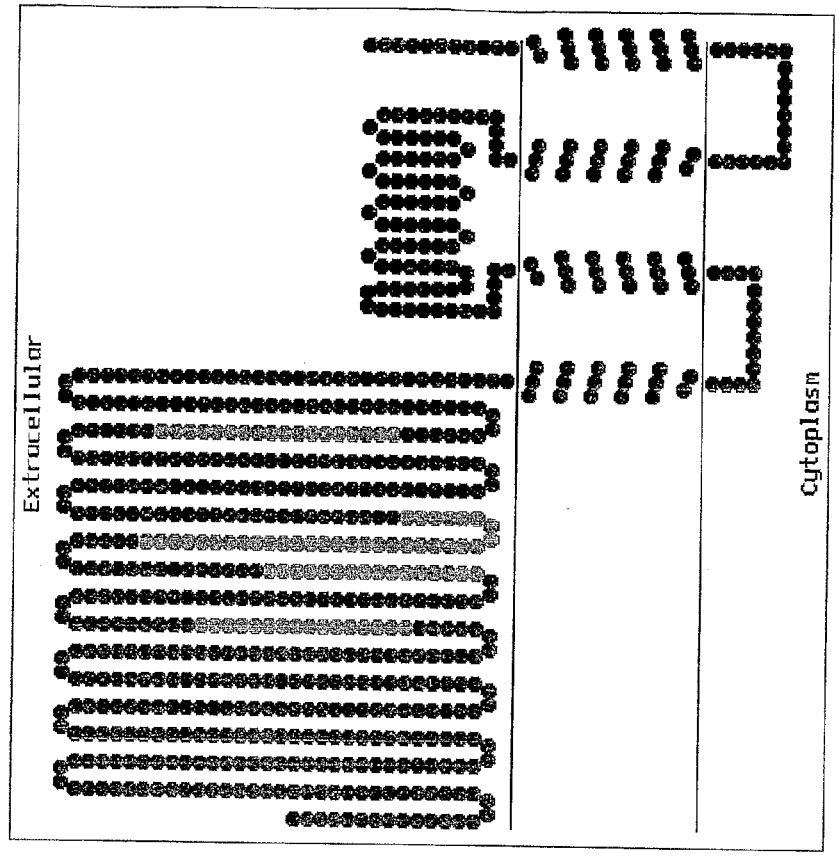

Features: Membrane

PSORT prediction
Signal Score (-7.5): -2.04 Possible cleavage site: 20
>>> Seems to have a cleavable N-term signal seq.

count: 4 value: -10.51 threshold: 0.0
INTEGRAL Likelihood =-10.51 Transmembrane 529 - 545 ( 517 - 551 )
INTEGRAL Likelihood =-10.30 Transmembrane 697 - 713 ( 693 - 719 )
INTEGRAL Likelihood = -4.41 Transmembrane 560 - 576 ( 555 - 585 )
INTEGRAL Likelihood = -0.32 Transmembrane 662 - 678 ( 662 - 678 )
PERIPHERAL Likelihood = 0.95 modified ALOM score: 2.60

Rule: cytoplasmic membrane protein FIG. 46
GAS587, SPY 1315, FACS RESPONSE POSITIVE

| gas | spy | FACS response |
|---|---|---|
| gas645 | spy2029 | NOT CLONED |

Features: Membrane

PSORT prediction

Signal Score (-7.5): -3.62 Possible cleavage site: 15
>>> Seems to have an uncleavable N-term signal seq count: 4 value: -11.57 threshold: 0.0
INTEGRAL Likelihood =-11.57 Transmembrane 23 - 39 ( 16 - 43)
INTEGRAL Likelihood =-11.36 Transmembrane 371 - 387 ( 362 - 396)
INTEGRAL Likelihood = -8.12 Transmembrane 331 - 347 ( 324 - 360)
INTEGRAL Likelihood = -7.70 Transmembrane 280 - 296 ( 277 - 308)
PERIPHERAL Likelihood = 3.61 modified ALOM score: 2.81

Rule: cytoplasmic membrane protein

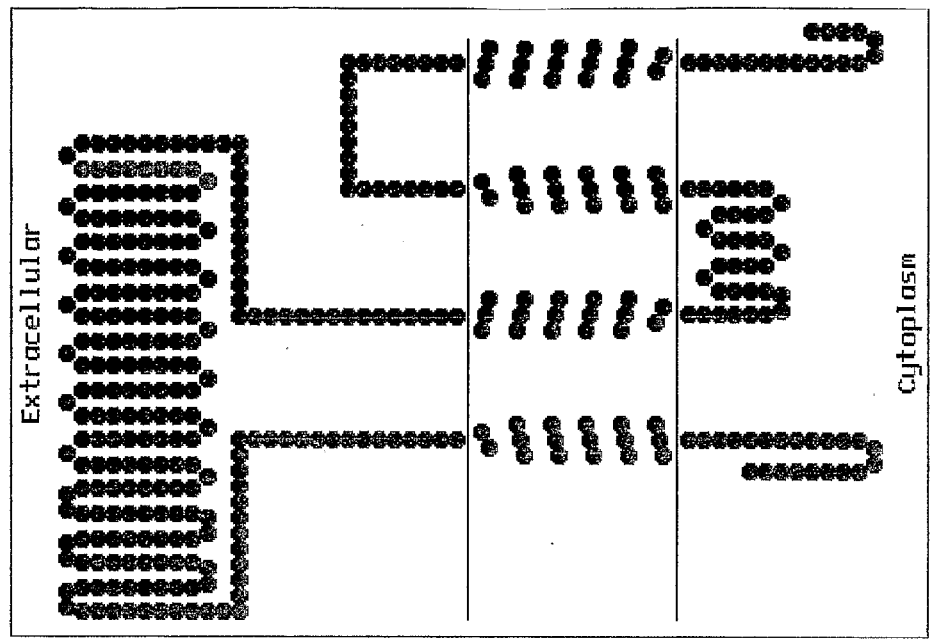

| G | ००० | FACS response |
|---|---|---|
| ⬛ | spy0277 | Positive |

Features: Membrane

PSORT prediction

Signal Score (-7.5): 4.49 Possible cleavage site: 22
>>> Seems to have a cleavable N-term signal seq.

count: 3 value: -6.26 threshold: 0.0
INTEGRAL Likelihood = -6.26 Transmembrane 301 - 317 ( 297 - 321 )
INTEGRAL Likelihood = -5.89 Transmembrane 479 - 495 ( 473 - 496 )
INTEGRAL Likelihood = -1.12 Transmembrane 369 - 385 ( 369 - 385 )
PERIPHERAL Likelihood = 1.32 modified ALOM score: 1.75

Rule: cytoplasmic membrane protein

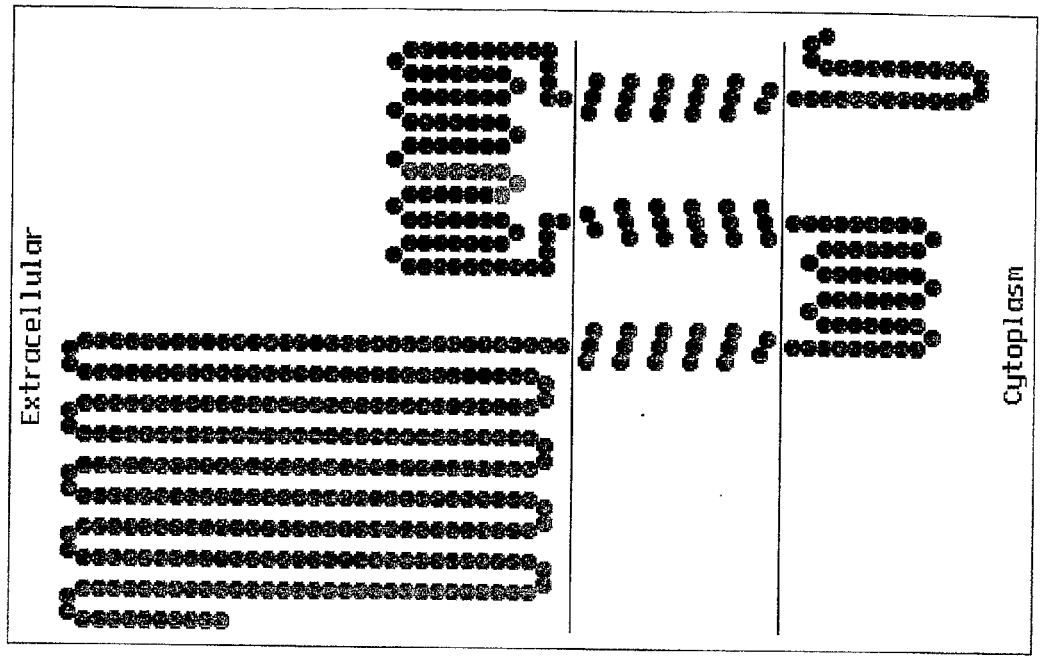

FIG. 48
GAS433, SPY 0277, FACS RESPONSE POSITIVE

| GAS | GBS | FACS response |
|---|---|---|
| gas545 | spy1740 | NOT CLONED |

Features: Membrane

PSORT prediction

Signal Score (-7.5): -3.81 Possible cleavage site: 55
>>> Seems to have no N-terminal signal seq.

count: 3 value: -8.39 threshold: 0.0
INTEGRAL Likelihood = -8.39 Transmembrane 284 - 300 (279 - 302)
INTEGRAL Likelihood = -4.88 Transmembrane 261 - 277 (257 - 278)
INTEGRAL Likelihood = -4.51 Transmembrane 181 - 197 (180 - 198)
PERIPHERAL Likelihood = 0.79 modified ALOM score: 2.18

Rule: cytoplasmic membrane protein

FIG. 49

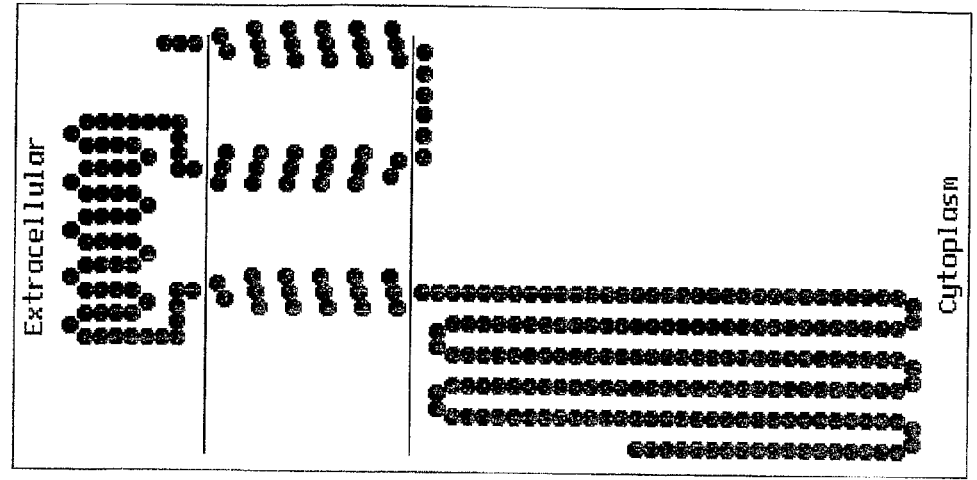

3 TM

| G | sp | FACS response |
|---|---|---|
| ▦ | spy0351 | ONLY FUSION 40 |

Features: Lipoprotein

PSORT prediction

Possible modific. site: 23
CRend: 6
Sequence Pattern: CVGR

Signal Score (-7.5): -1.3 Possible cleavage site: 31
>>> May be a lipoprotein count: 3 value: -9.55 threshold: 0.0
INTEGRAL Likelihood = -9.55 Transmembrane 62 - 78 ( 54 - 82)
INTEGRAL Likelihood = -2.81 Transmembrane 178 - 194 ( 177 - 195)
INTEGRAL Likelihood = -0.90 Transmembrane 216 - 232 ( 215 - 232)

PERIPHERAL Likelihood = 0.58 modified ALOM score: 2.41

Rule: cytoplasmic membrane protein

FIG. 50
GAS54, SPY 0351

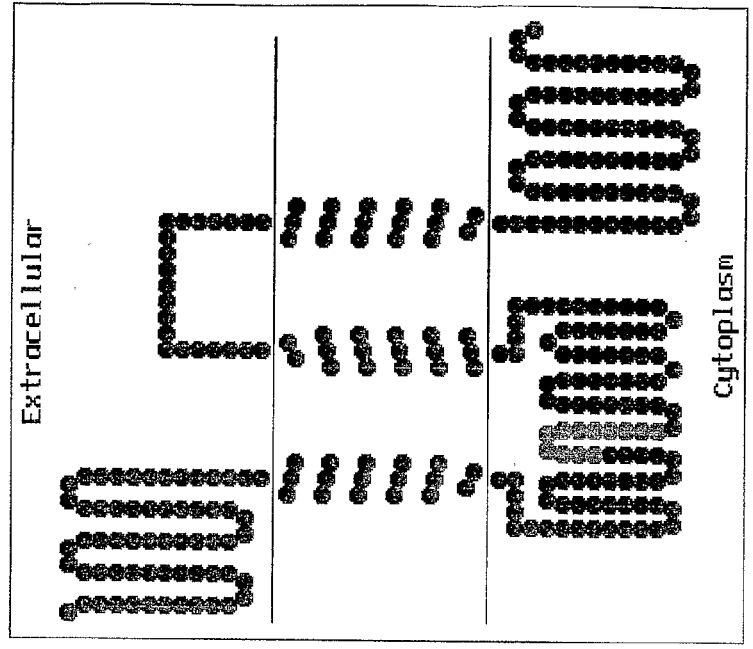

3 TM Lipoprotein

GAS40, SPY 0269

GAS163, SPY 1154

| ORF | | FACS response |
|---|---|---|
| gas198 | spy2184 | Negative |

Features: Membrane

PSORT prediction
Signal Score (-7.5): -3.79 Possible cleavage site: 25
>>> Seems to have an uncleavable N-term signal seq count: 2 value: -18.57 threshold: 0.0
INTEGRAL Likelihood =-18.57 Transmembrane 33 - 49 ( 6 - 56)
INTEGRAL Likelihood =-10.14 Transmembrane 12 - 28 ( 6 - 32)
PERIPHERAL Likelihood = 2.44 modified ALOM score: 4.21

Rule: cytoplasmic membrane protein

2 TM

| gene | sp|y | FACS response |
|---|---|---|
| gas224 | spy1044 | NOT CLONED |

Features: Membrane

PSORT prediction

Signal Score (-7.5): -0.659999 Possible cleavage site: 18

>>> Seems to have a cleavable N-term signal seq.

count: 2 value: -7.32 threshold: 0.0
INTEGRAL Likelihood = -7.32 Transmembrane 126 - 142 (118 - 145)
INTEGRAL Likelihood = -6.90 Transmembrane 178 - 194 (177 - 203)
PERIPHERAL Likelihood = 0.79 modified ALOM score: 1.96

Rule: cytoplasmic membrane protein

2 TM

| G<s> | <s>L | FACS response |
|---|---|---|
| gas500 | spy1410 | NOT CLONED |

Features: Membrane

PSORT prediction

Signal Score (-7.5): -1.18 Possible cleavage site: 49
>>> Seems to have no N-terminal signal seq.

count: 2 value: -11.83 threshold: 0.0
INTEGRAL Likelihood =-11.83 Transmembrane 241 - 257 ( 234 - 266)
INTEGRAL Likelihood = -4.41 Transmembrane 27 - 43 ( 26 - 44)
PERIPHERAL Likelihood = 2.28 modified ALOM score: 2.87

Rule: cytoplasmic membrane protein

GAS4, SPY 0015

GAS72, SPY 0903

| ORF | SPy | FACS response |
|---|---|---|
| gas152 | spy0802 | Negative |

Features: Membrane

PSORT prediction

Signal Score (-7.5): -4.12 Possible cleavage site: 43
>>> Seems to have no N-terminal signal seq.

count: 1 value: -15.97 threshold: 0.0
INTEGRAL Likelihood =-15.97 Transmembrane 35 - 51 ( 25 - 58 )
PERIPHERAL Likelihood = 5.20 modified ALOM score: 3.69

Rule: Cytoplasmic membrane protein

GAS152, SPY 0802

| S | OQ> | FACS response |
|---|---|---|
| ▯▯▯▯ | ▯▯▯▯▯▯▯▯▯▯▯▯ | Positive |

Features: Membrane

PSORT prediction

Signal Score (-7.5): -6.52 Possible cleavage site: 42
>>> Seems to have an uncleavable N-term signal seq count: 1 value: -9.61 threshold: 0.0
INTEGRAL Likelihood = -9.61 Transmembrane 15 - 31 (11 - 36)
PERIPHERAL Likelihood = 1.32 modified ALOM score: 2.42

Rule: cytoplasmic membrane protein

GAS157, SPY 0836

GAS259, SPY 1586

GAS177, SPY 1649

| ORF | GAS | FACS response |
|---|---|---|
| gas193 | spy2025 | Negative |

Features: Membrane

PSORT prediction

Signal Score (-7.5): -3.83 Possible cleavage site: 19
>>> Seems to have an uncleavable N-term signal seq count: 1 value: -3.77 threshold: 0.0
INTEGRAL Likelihood = -3.77 Transmembrane 9 - 25 ( 5 - 27 )
PERIPHERAL Likelihood = 3.29 modified ALOM score: 1.25

Rule: cytoplasmic membrane protein

Features: Membrane

PSORT prediction

Signal Score (-7.5): -4.21 Possible cleavage site: 26
>>> Seems to have an uncleavable N-term-signal seq count: 1 value: -2.60 threshold: 0.0
INTEGRAL Likelihood = -2.60 Transmembrane 15 - 31 (12 - 32)
PERIPHERAL Likelihood = 9.02 modified ALOM score: 1.02

Rule: cytoplasmic membrane protein

GAS194, SPY 2032

Features: Membrane

PSORT prediction

Signal Score (-7.5): -1.6 Possible cleavage site: 28
>>> Seems to have no N-terminal signal seq.

count: 1 value: -1.38 threshold: 0.0
INTEGRAL Likelihood = -1.38 Transmembrane 16 - 32 ( 16 - 32)
PERIPHERAL Likelihood = 7.32 modified ALOM score: 0.78

Rule: cytoplasmic membrane protein

GAS195, SPY 2043

| GAS | SPY | FACS response |
|---|---|---|
| gas149 | spy0780 | Positive |

Features: Membrane

PSORT prediction

Signal Score (-7.5): 0.0299997 Possible cleavage site: 28

>>> Seems to have a cleavable N-term signal seq.

count: 1 value: -5.95 threshold: 0.0
INTEGRAL Likelihood = -5.95 Transmembrane 71 - 87 ( 67 - 90 )
PERIPHERAL Likelihood = 3.18 modified ALOM score: 1.69

Rule: cytoplasmic membrane protein

GAS149, SPY 0780

| GAS | ORF | FACS response |
|---|---|---|
| gas149 | spy0780 | Positive |

Features: Membrane

PSORT prediction

Signal Score (-7.5): 0.0299997 Possible cleavage site: 28

>>> Seems to have a cleavable N-term signal seq.

count: 1 value: -5.95 threshold: 0.0
INTEGRAL Likelihood = -5.95 Transmembrane 71 - 87 ( 67 - 90 )
PERIPHERAL Likelihood = 3.18 modified ALOM score: 1.69

Rule: cytoplasmic membrane protein

GAS149, SPY 0780

GAS201, SPY 2216

| gas | spy | FACS response |
|---|---|---|
| gas251 | spy1520 | Positive |

Features: Membrane

PSORT prediction

Signal Score (-7.5): -1.75 Possible cleavage site: 56
>>> Seems to have a cleavable N-term signal seq.

count: 1 value: -1.81 threshold: 0.0
INTEGRAL Likelihood = -1.81 Transmembrane 117 - 133 ( 117 - 133)
PERIPHERAL Likelihood = 3.13 modified ALOM score: 0.86

Rule: cytoplasmic membrane protein

GAS251, SPY 1520

GAS259, SPY 1586

| S | V | FACS response |
|---|---|---|
|   |   | NOT CLONED |

Features: Membrane

PSORT prediction

Signal Score (-7.5): 1.3 Possible cleavage site: 57
>>> Seems to have no N-terminal signal seq.

count: 1 value: -5.15 threshold: 0.0
INTEGRAL Likelihood = -5.15 Transmembrane 42 - 58 ( 41 - 60 )
PERIPHERAL Likelihood = 2.28 modified ALOM score: 1.53

Rule: cytoplasmic membrane protein

GAS264, SPY 1686 cytoplasmic membrane protein FIG. 71
GAS268, SPY 1798

| S<G | Sup | FACS response |
|---|---|---|
| | | Positive |

Features: Membrane

PSORT prediction

Signal Score (-7.5): -0.82 Possible cleavage site: 31
>>> Seems to have a cleavable N-term signal seq.

count: 1 value: -10.77 threshold: 0.0
INTEGRAL Likelihood =-10.77 Transmembrane 242 - 258 ( 238 - 262)
PERIPHERAL Likelihood = 9.39 modified ALOM score: 2.65

Rule: cytoplasmic membrane protein

GAS277, SPY 1939

Features: Membrane

PSORT prediction

Signal Score (-7.5): -0.93 Possible cleavage site: 55
>>> Seems to have no N-terminal signal seq.

count: 1 value: -6.64 threshold: 0.0
INTEGRAL Likelihood = -6.64 Transmembrane 46 - 62 ( 43 - 65 )
PERIPHERAL Likelihood = 11.14 modified ALOM score: 1.83

Rule: cytoplasmic membrane protein

GAS282, SPY 2033

| ORF | gene | FACS response |
|---|---|---|
| gas299 | spy1188 | NOT CLONED |

Features: Membrane

PSORT prediction

Signal Score (-7.5): 4.07 Possible cleavage site: 16
>>> Seems to have no N-terminal signal seq.

count: 1 value: -1.65 threshold: 0.0
INTEGRAL Likelihood = -1.65 Transmembrane 74 - 90 ( 74 - 90 )
PERIPHERAL Likelihood = 2.65 modified ALOM score: 0.83

Rule: cytoplasmic membrane protein

GAS299, SPY 1188

GAS262, SPY 1643

| GAS | SPY | FACS response |
|---|---|---|
| gas405 | spy1028 | Positive |

Features: Membrane

PSORT prediction

Signal Score (-7.5): -0.75 Possible cleavage site: 18
>>> Seems to have no N-terminal signal seq.

count: 1 value: -0.00 threshold: 0.0
INTEGRAL Likelihood = -0.00 Transmembrane 81 - 97 ( 81 - 97 )
PERIPHERAL Likelihood = 2.70 modified ALOM score: 0.50

Rule: cytoplasmic membrane protein

SPY 405, SPY 1028

| ORF | ORF | FACS response |
|---|---|---|
| gas406 | spy1031 | Positive |

Features: Membrane

PSORT prediction

Signal Score (-7.5): -7.86 Possible cleavage site: 50
>>> Seems to have no N-terminal signal seq.

count: 1 value: -1.70 threshold: 0.0
INTEGRAL Likelihood = -1.70 Transmembrane 297 - 313 (297 - 315)
PERIPHERAL Likelihood = 4.93 modified ALOM score: 0.84

Rule: cytoplasmic membrane protein

GAS406, SPY 1031

Features: Lipoprotein

PSORT prediction

Possible modific. site: 20 CRend: 3 Sequence Pattern: CTNN

Signal Score (-7.5): -1.5 Possible cleavage site: 17
>>> May be a lipoprotein

GAS23, SPY 0163

| GAS | SPY | FACS response |
|---|---|---|
| gas45 | NT01SP0246 | Negative |

Features: Lipoprotein

PSORT prediction

Possible modific. site: 22 CRend: 4
Sequence Pattern: CGNK

Signal Score (-7.5): 0.66  Possible cleavage site: 21
>>> May be a lipoprotein count: 0 value: 5.04 threshold: 0.0
PERIPHERAL Likelihood = 5.04 modified ALOM score: -1.51

GAS45; NT01SP0246

| GAS | SPY | FACS response |
|---|---|---|
| gas49 | spy0317 | Positive |

Features:   Lipoprotein

PSORT prediction

Possible modific. site: 22 CRend: 8
Sequence Pattern: CGSS

Signal Score (-7.5): 1.76 Possible cleavage site: 21
>>> May be a lipoprotein count: 0 value: 5.46 threshold: 0.0

PERIPHERAL Likelihood = 5.46 modified ALOM score: -1.59 51

GAS49, SPY 0317

Features: Lipoprotein

PSORT prediction

Possible modific. site: 19
CRend: 2
Sequence Pattern: CESV

Signal Score (-7.5): -4.69
Possible cleavage site: 19
>>> May be a lipoprotein count: 0 value: 6.10 threshold: 0.0

PERIPHERAL Likelihood = 6.10 modified ALOM score: -1.72

GAS63, SPY 0457

| G<S | SC> | FACS response |
|---|---|---|
| gas84 | spy1274 | Positive |

Features: Lipoprotein

PSORT prediction

Possible modific. site: 21
CRend: 5 Sequence Pattern: CQAT

Signal Score (-7.5): 0.48 Possible cleavage site: 21
>>> May be a lipoprotein count: 0 value: 10.93 threshold: 0.0
PERIPHERAL Likelihood = 10.93 modified ALOM score: -2.69

GAS84, SPY 1274

Features: lipoprotein

PSORT prediction

Possible modific. site: 23
CRend: 5 Sequence Pattern: CGSG

Signal Score (-7.5): -1 Possible cleavage site: 28
>>> May be a lipoprotein count: 0 value: 8.43 threshold: 0.0
PERIPHERAL Likelihood = 8.43 modified ALOM score: -2.19

GAS86, SPY 1294

| S>O | >opV | FACS response |
|---|---|---|
| ▭▭▭▭ | ▭▭▭▭▭▭▭▭ | Positive |

Features: Lipoprotein

PSORT prediction

Possible modific. site: 22
CRend: 5 Sequence Pattern: CQST

Signal Score (-7.5): 1.6 Possible cleavage site: 21
>>> May be a lipoprotein count: 0 value: 6.79 threshold: 0.0 PERIPHERAL Likelihood = 6.79
modified ALOM score: -1.86

GAS89, SPY 1390

Features: Lipoprotein

PSORT prediction

Possible modific. site: 21
CRend: 4 Sequence Pattern: CAKV

Signal Score (-7.5): -5 Possible cleavage site: 25
>>> May be a lipoprotein count: 0 value: 9.81 threshold: 0.0
PERIPHERAL Likelihood = 9.81 modified ALOM score: -2.46

GAS98, SPY 1882

| S<G | >GL | FACS response |
|---|---|---|
| ▭ | ▭ | Positive |

| GAS | spy | FACS response |
|---|---|---|
| gas103 | spy2037 | Positive |

Features: Lipoprotein

PSORT prediction

Possible modific. site: 22
CRend: 5 Sequence Pattern: CQSS

Signal Score (-7.5): -5.79 Possible cleavage site: 21
>>> May be a lipoprotein count: 0 value: 6.36 threshold: 0.0 PERIPHERAL Likelihood = 6.36
modified ALOM score: -1.77

GAS103, SPY 2037

Features: Lipoprotein

PSORT prediction

Possible modific. site: 19
CRend: 5 Sequence Pattern: CSQG

Signal Score (-7.5): -2.5 Possible cleavage site: 19
>>> May be a lipoprotein count: 0 value: 12.63 threshold: 0.0 PERIPHERAL Likelihood = 12.63

GAS 108, SPY 0604

| GAS | SDS | YDS | FACS response |
|---|---|---|---|
|  |  |  | Positive |

Features: Lipoprotein

PSORT prediction

Possible modific. site: 21 CRend: 4
Sequence Pattern: CSEK

Signal Score (-7.5): -1.64 Possible cleavage site: 21
>>> May be a lipoprotein

GAS685, SPY 0319

| S>G | S>P | S>Y | | FACS response |
|---|---|---|---|---|
| | | | | Positive |

Features: Outside

PSORT prediction

Signal Score (-7.5): 0.759999 Possible cleavage site: 33
>>> Seems to have a cleavable N-term signal seq.

count: 0 value: 5.57 threshold: 0.0 PERIPHERAL
Likelihood = 5.57 modified ALOM score: -1.61

GAS24, SPY 0165

Features: Outside

PSORT prediction

Signal Score (-7.5): -0.200001 Possible cleavage site: 17
>>> Seems to have a cleavable N-term signal seq.

GAS5, SPY 0019

Features: Outside

PSORT prediction
Signal Score (-7.5): -1.69 Possible cleavage site: 31
>>> Seems to have a cleavable N-term signal seq.

count: 0 value: 5.62 threshold: 0.0 PERIPHERAL
Likelihood = 5.62 modified ALOM score: -1.62

GAS25, SPY 0167

Features: Outside

PSORT prediction
Signal Score (-7.5): 2.56
Possible cleavage site: 25
>>> Seems to have a cleavable N-term signal seq.

count: 0 value: 4.83 threshold: 0.0

PERIPHERAL Likelihood = 4.83 modified ALOM score: -1.47

GAS64, SPY 0469

GAS87, SPY 1302

Features: Outside

PSORT prediction

Signal Score (-7.5): 2.06 Possible cleavage site: 32
>>> Seems to have a cleavable N-term signal seq.

count: 0 value: 15.86 threshold: 0.0
PERIPHERAL Likelihood = 15.86 modified ALOM score: -3.67

GAS102, SPY 2016

| S | G A S | s p y | FACS response |
|---|---|---|---|
| | gas362 | spy1461 | Positive |

Features: Outside

PSORT prediction

Signal Score (-7.5): 1.08 Possible cleavage site: 25
>>> Seems to have a cleavable N-term signal seq.

count: 0 value: 8.17 threshold: 0.0
PERIPHERAL Likelihood = 8.17 modified ALOM score: -2.13

GAS362, SPY 1461

Features: Outside (membrane?)

PSORT prediction

Signal Score (-7.5): -1.6 Possible cleavage site: 43
>>> Seems to have a cleavable N-term signal seq.

count: 0 value: 5.73 threshold: 0.0
PERIPHERAL Likelihood = 5.73 modified ALOM score: -1.65

GAS382, SPY 1842

| G A G | FACS response |
|---|---|
| S P S | NOT CLONED | putative signal peptidase I

Features: ?

PSORT prediction

Signal Score (-7.5): -3 Possible cleavage site: 14
>>> Seems to have no N-terminal signal seq.

count: 0 value: 9.02 threshold: 0.0 PERIPHERAL Likelihood = 9.02
modified ALOM score: -2.30

Rule: cytoplasmic protein

SPY 0127

| S | S>G | FACS response | |
|---|---|---|---|
| | Sp | NOT CLONED | hypothetical protein, phage associated |

Features: ?

PSORT prediction

Signal Score (-7.5): -4.21 Possible cleavage site: 60
>>> Seems to have no N-terminal signal seq.

count: 0 value: 5.62 threshold: 0.0 PERIPHERAL Likelihood = 5.62
modified ALOM score: -1.62

Rule: cytoplasmic protein

SPY 0686

| GAS | SPY | FACS response |
|---|---|---|
| NS | Spy0792 | NOT CLONED | conserved hypothetical protein, possibly involved in cell wall localization and side chain formation of polysacch.

Features: ?

PSORT prediction

Signal Score (-7.5): -5.73 Possible cleavage site: 32
>>> Seems to have no N-terminal signal seq.

count: 0 value: 2.97 threshold: 0.0 PERIPHERAL Likelihood = 2.97
modified ALOM score: -1.09

Rule: cytoplasmic protein

SPY 0792

Features: ?

PSORT prediction

Signal Score (-7.5): -7.86 Possible cleavage site: 50
>>> Seems to have no N-terminal signal seq.

count: 0 value: 0.32 threshold: 0.0 PERIPHERAL Likelihood = 0.32
modified ALOM score: -0.56

Rule: cytoplasmic protein

SPY 1029

Features: ?

PSORT prediction

Signal Score (-7.5): -4.75 Possible cleavage site: 43
>>> Seems to have no N-terminal signal seq.
count: 0 value: 3.13 threshold: 0.0 PERIPHERAL Likelihood = 3.13
modified ALOM score: -1.13

Rule: cytoplasmic protein

SPY 1260

Features: ?

PSORT prediction

Signal Score (-7.5): -7.65 Possible cleavage site: 16
>>> Seems to have no N-terminal signal seq.

count: 0 value: 9.81 threshold: 0.0 PERIPHERAL Likelihood = 9.81
modified ALOM score: -2.46

Rule: cytoplasmic protein

SPY 1613

| S⊲G | ɷ⌒ | FACS response | |
|---|---|---|---|
| □b | ɑ▭▯▯▯▯ | NOT CLONED | putative thioredoxin |

Features: ?

PSORT prediction

Signal Score (-7.5): -5.28 Possible cleavage site: 34
>>> Seems to have no N-terminal signal seq.

count: 0 value: 6.36 threshold: 0.0 PERIPHERAL Likelihood = 6.36
modified ALOM score: -1.77

Rule: cytoplasmic protein

SPY 1835

| S<G | sa> | FACS response | |
|---|---|---|---|
| | ▭▯▯▯▯▯ | NOT CLONED | hypothetical protein |

Features: ?

PSORT prediction

Signal Score (-7.5): -6.52 Possible cleavage site: 41
>>> Seems to have no N-terminal signal seq.

count: 0 value: 14.22 threshold: 0.0 PERIPHERAL Likelihood = 14.22
modified ALOM score: -3.34

Rule: cytoplasmic protein

SPY 2005

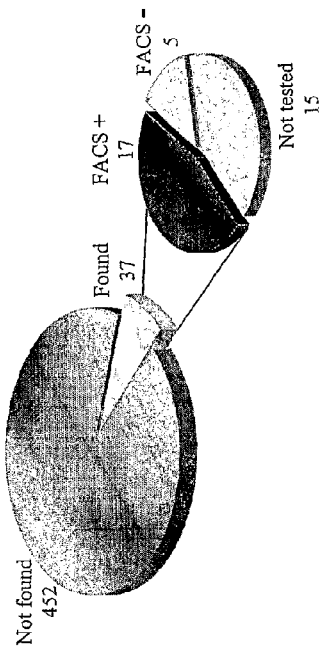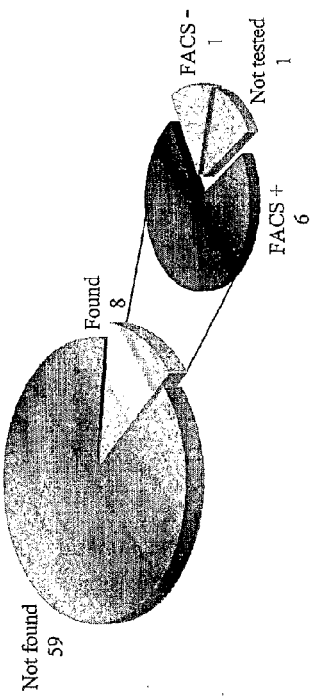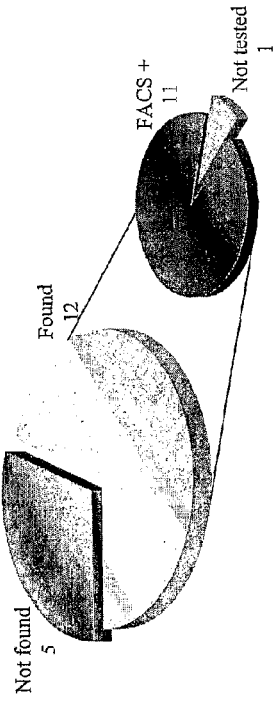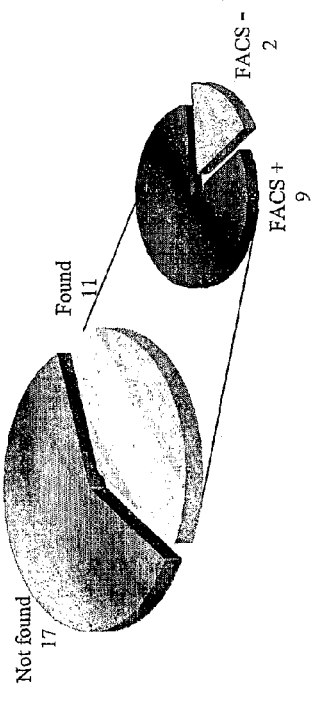
FIG. 106

DSM 2071 M23

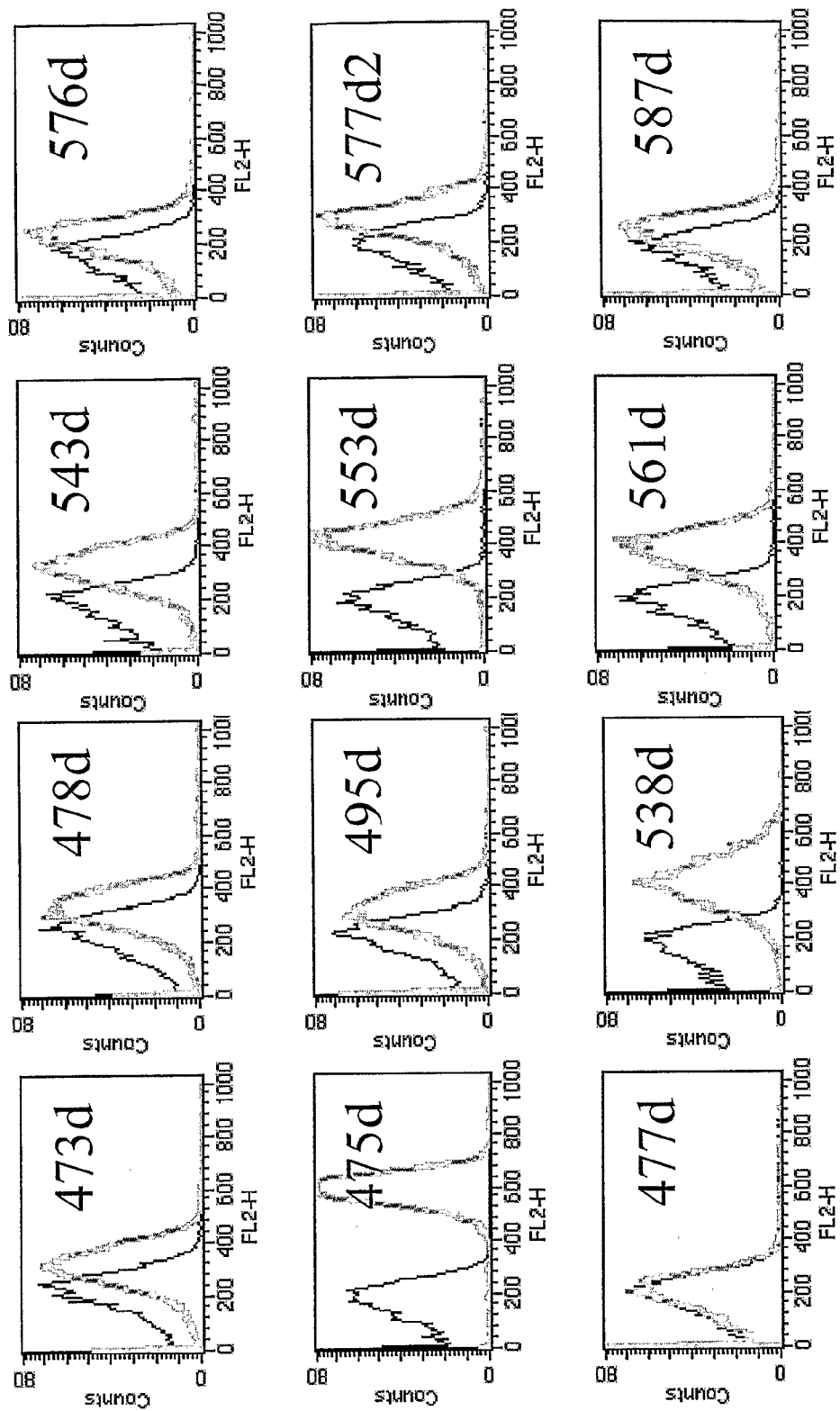

2728 EM5 M12

IMMUNOGENIC AND THERAPEUTIC COMPOSITIONS FOR *STREPTOCOCCUS PYOGENES*

This application claims the benefit of and incorporates by reference co-pending provisional application Ser. No. 60/616,854 filed Oct. 8, 2004; Ser. No. 60/652,736 filed Feb. 15, 2005; Ser. No. 60/701,121 filed Jul. 21, 2005; and Ser. No. 60/705,209 filed Aug. 4, 2005.

This application incorporates by reference the contents of a 1.75 MB text file created on Nov. 9, 2009 and named "SN11792038_sequencelisting.txt," which is the sequence listing for this application.

FIELD OF THE INVENTION

This invention is in the fields of immunology and vaccinology. In particular, it relates to antigens derived from *Streptococcus pyogenes* and their use in immunization.

BACKGROUND OF THE INVENTION

Group A streptococcus ("GAS," *S. pyogenes*) is a frequent human pathogen, estimated to be present in between 5-15% of normal individuals without signs of disease. An acute infection occurs, however, when host defenses are compromised, when the organism is able to exert its virulence, or when the organism is introduced to vulnerable tissues or hosts. Related diseases include puerperal fever, scarlet fever, erysipelas, pharyngitis, impetigo, necrotizing fasciitis, myositis, and streptococcal toxic shock syndrome.

GAS bacteria are gram positive, non-spore forming coccus-shaped bacteria which typically exist in chains or in pairs of cells. GAS bacteria are subdivided according to serotyping based on a large, highly variable cell surface antigen call the M protein. Lancefield, J. Exp. Med. 47, 9-10, 1928; Lancefield, J. Immunol. 89, 307-13, 1962. DNA sequencing of genes encoding M proteins has become the most common method of determining GASM types (emm sequence types). To date 124 different M types have been identified; 22 of these types were identified between 1995 and 1998 (Facklam et al., Clin. Infect. Dis. 34, 28-38, 2002). M1, M28, M12, M3, M11, and M6 are among the most prevalent GAS types worldwide. Li et al., Infect. Dis. 188, 1587-92, 2003; O'Brien et al., Clin. Infect. Dis. 35, 268-76, 2002.

Although *S. pyogenes* infections can be treated using antibiotics, there is a need in the art for prophylactic vaccines to prevent the onset of disease, as well as for additional therapies for treating *S. pyogenes* infections.

BRIEF DESCRIPTION OF THE FIGURES

FIG. 1. Alignment of the amino acid sequences of GAS40 proteins from GASM strains SF370, 2580, 3280, 3348, 3789, and 2913 (SEQ ID NO:17) 2634 (SEQ ID NO:18), 2726 (SEQ ID NO:19), 2721 (SEQ ID NO:20), 3040 and 3135 (SEQ ID NO:21), 2722 (SEQ ID NO:22), 2728 (SEQ ID NO:23), 4883 (SEQ ID NO:24), 2724 (SEQ ID NO:25), 2894, 3650, 5529, and 3776 (SEQ ID NO:26), 2720 (SEQ ID NO:27), 2725 (SEQ ID NO:28), 4538 (SEQ ID NO:29), 5531 (SEQ ID NO:30), 5481 (SEQ ID NO:31), 4959 (SEQ ID NO:32), D2071 (SEQ ID NO:33), 4436 (SEQ ID NO:34), 2727 (SEQ ID NO:35), 2719 (SEQ ID NO:36), 5455 (SEQ ID NO:37), 5476 (SEQ ID NO:38), 4088 (SEQ ID NO:39), MANFR10394 (SEQ ID NO:40), M8232 (SEQ ID NO:41), M315 (SEQ ID NO:42), and SS1 (SEQ ID NO:43). FIG. 1A, amino acids 1-50; FIG. 1B, amino acids 51-100; FIG. 1C, amino acids 101-150; FIG. 1D, amino acids 151-200; FIG. 1E, amino acids 201-250; FIG. 1F, amino acids 251-300; FIG. 1G, amino acids 301-350; FIG. 1H, amino acids 351-400; FIG. 1I, amino acids 401-450; FIG. 1J, amino acids 451-500; FIG. 1K, amino acids 501-550; FIG. 1L, amino acids 551-600; FIG. 1M, amino acids 601-650; FIG. 1N, amino acids 651-700; FIG. 1O, amino acids 701-750; FIG. 1P, amino acids 751-800; FIG. 1Q, amino acids 801-850; FIG. 1R, amino acids 851-873.

FIG. 4A-B. Results of FACS analysis demonstrating that antisera directed against a "GST-GAS40" antigen detects GAS40 protein on the cell surface of strains of different M types. FIG. 4A, strains 3789, 4883, a hypocapsulated mutant of DSM2071, 5476, SF370, DSM2071, 2720, 2723, 2728, 2724, 2580, 2725, 2719, 2726, 3776. FIG. 4B, strains 4436, 2721, 4959, 2727, 5468, 3650, 2634, 4088, 4538, 2722.

FIG. 5A, DSM2071, SF370, 2721, 3280, 2728, 3789, a hypocapsulated mutant of DSM2071, 4883, 5476, 2725, 2720, 2726, 2723, 2728, 2724, and 2580; FIG. 5B, 2719, 5468, 3776, 2634, 4436, 2721, 4959, 2727, 3650, 4088, 4538, and 2722.

FIG. 6A, strains DSM2071, 3280, 2721, 3789, 2728, 4883, a hypocapsulated mutant of DSM2071, 5476, SF370, 2720, 2723, 2580, 2724, 2719, 2725, 3776, 2726, 4436, 2728, and 4959; FIG. 6B, strains 5468, 4088, 2634, 4538, 2721, 2722, 2727, and 3650.

FIG. 8. Results of FACS analysis demonstrating that antisera directed against a GAS117/GAS40 hybrid antigen detects GAS40 protein on the cell surface of strains of different M types (strains DSM2071, 2634, a hypocapsulated mutant of DSM2071, 2727, 3789, 2720, SF370, 2725, 2580, 2894, 2728, 2913, 2726, 3348, 3280).

FIG. 9A, strains DSM2071, 3280, 2721, 4789, 2728, 4883, a hypocapsulated mutant of DSM2071, 5476, SF370, 2720, 2723, 2580, 2724, 2719, 2725, 3776, 2726, 4436, 2728, 4959; FIG. 9B, strains 5468, 4088, 2634, 4538, 2721, 2722, 2727, 3650.

FIG. 10A, strains DSM2071, 3280, 2721, 3789, 2728, 4883 a hypocapsulated mutant of DSM2071, 5476, SF370, 2720, 2723, 2580, 2724, 2719, 2725, 3776, 2726, 4436, 2728, 4959; FIG. 10B, strains 5468, 4088, 2634, 4538, 2721, 2722, 2727, 3650.

FIG. 11A-B. Results of FACS analysis demonstrating that antisera directed against a GAS40aRRNH antigen detects GAS40 protein on the cell surface of strains of different M types. FIG. 11A, strains DSM2071, 3280, 2721, 3789, 2728, 4883, a hypocapsulated mutant of DSM2071, 5476, SF370, 2720, 2723, 2580, 2724, 2719, 2725, 3776, 2726, 4436, 2728, 4959; FIG. 11B, strains 5468, 4088, 2634, 4538, 2721, 2722, 2727, 3650.

FIG. 12A-B. Diagram of expression vectors and recombinant GAS antigens. FIG. 12A, expression vectors pET-21+ and pGEX; FIG. 12B, encoded recombinant proteins.

FIG. 13. Schematic view of mouse model.

FIG. 14. Mouse model results.

FIG. 15. Schematic view of GAS40 structure.

FIG. 16. Western blots showing expression of GAS40 in different GAS serotypes.

FIG. 17. FACS pictograms showing surface expression of GAS40.

FIG. 18. Photomicrographs showing distribution of GAS40 on the bacterial cell surface.

FIG. 19. Graph illustrating bactericidal properties of anti-GAS40 antibodies.

FIG. 20. Graph illustrating opsonization properties of anti-GAS40 antibodies.

FIG. 21. Schematic view of GAS40 domains.

FIG. 22. Graph illustrating time course survival results for mice immunized with GAS40N (SEQ ID NO:930).

FIG. 23. FACS data demonstrating that GAS40 is surface exposed across different M strains.

FIG. 25A-B. Peptides derived from proteinase K digestion of GAS190 aligned with the full-length amino acid sequence of GAS190 (SEQ ID NO:117). FIG. 25A, individual peptides (SEQ ID NOS:932-949); FIG. 25B, schematic.

Figure 26B:
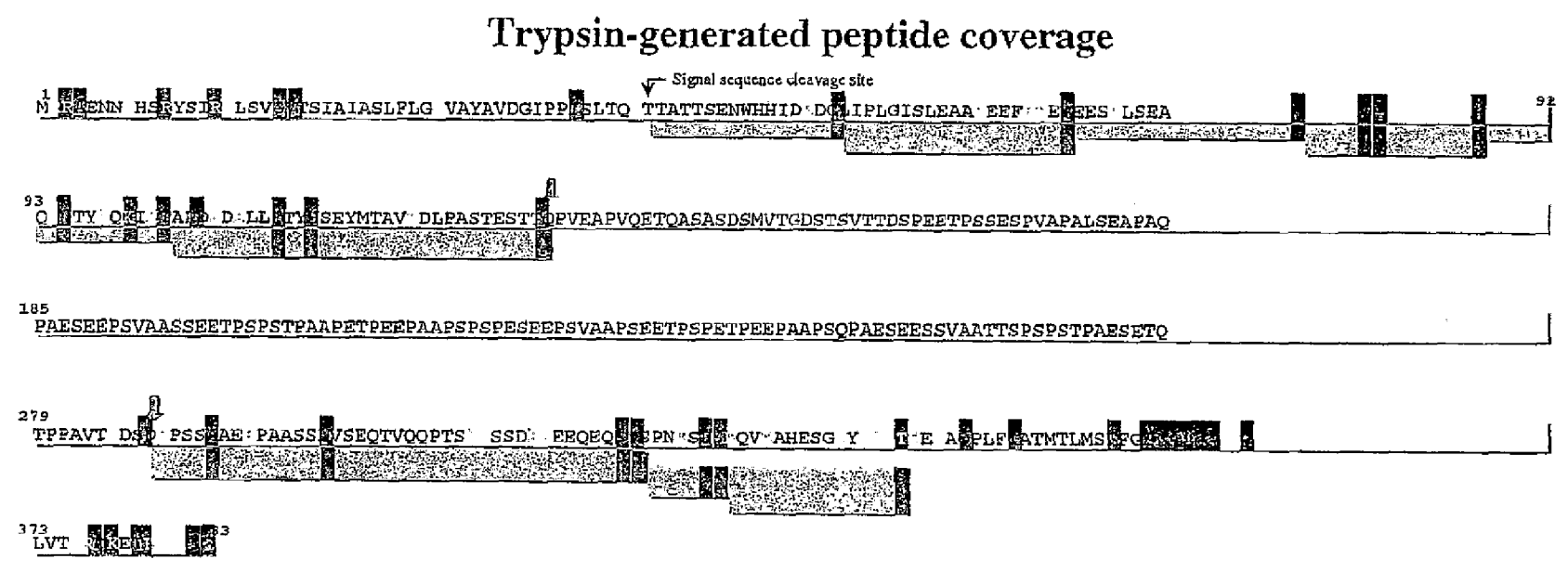

FIG. 26A-B. Peptides derived from trypsin digestion of GAS190 aligned with the full-length amino acid sequence of GAS190 (SEQ ID NO:117). FIG. 26A, individual peptides (SEQ ID NOS:950-961); FIG. 26B, schematic.

FIG. 27. Summary of predicted LPXTG (SEQ ID NO:931) proteins.

FIG. 105A shows the proteins whose peptides identified by proteomics matched extracellular domains predicted by PSORT. FIG. 105B shows those membrane proteins whose peptides identified by proteomics matched cytoplasmic domains predicted by PSORT.

FIG. 106. Comparison between found and predicted proteins for each of the four types of surface-associated proteins in *Streptococcus pyogenes* and FACS responses of those identified. LPXTG proteins: 17 proteins containing the LPXTG (SEQ ID NO:931)-anchoring motif to the cell wall were predicted to be present in the genome; 12 (71%) were found and 5 (29%) were not. Of those identified, 11 were tested and all of them were positive. Membrane proteins: 489 membrane proteins were predicted by in silico analysis; 452 (92%) were not found, whereas the number of found proteins was 37 (8%); 15 were not tested by FACS. Of those tested, 17 (77%) exhibited a positive response; 5 (23%) were negative. Lipoproteins: 11 lipoproteins out of 28 predicted by in silico analysis (39%) were found; 17 (61%) were not found. All of those identified were FACS-tested, and 9 (81%) were positive; 2 lipoproteins (19%) exhibited a negative response. Secreted proteins: 67 secreted proteins were predicted; 59 (88%) were not found, and 8 (12%) were found. Of these, one was not tested by FACS. Out of those tested, 6 (86%) were positive, and only one (14%) was negative.

FIG. 110A-C. FACS pictograms of surface-exposed GAS antigens.

DETAILED DESCRIPTION OF THE INVENTION

Figure 2:
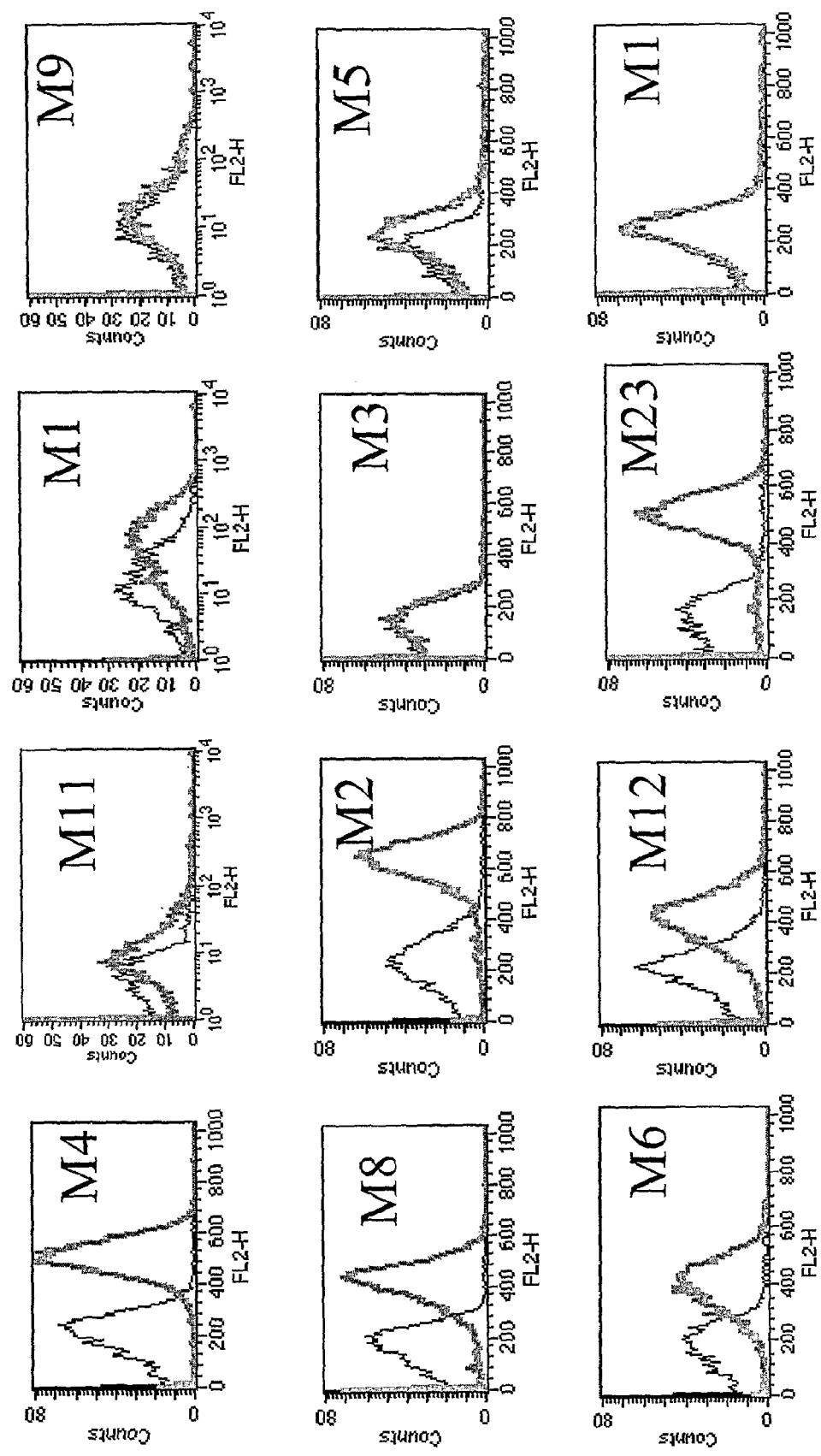
FIG. 2. Results of FACS analysis demonstrating that GAS40 proteins are exposed on the cell surface of strains of different M types.
Figure 3:
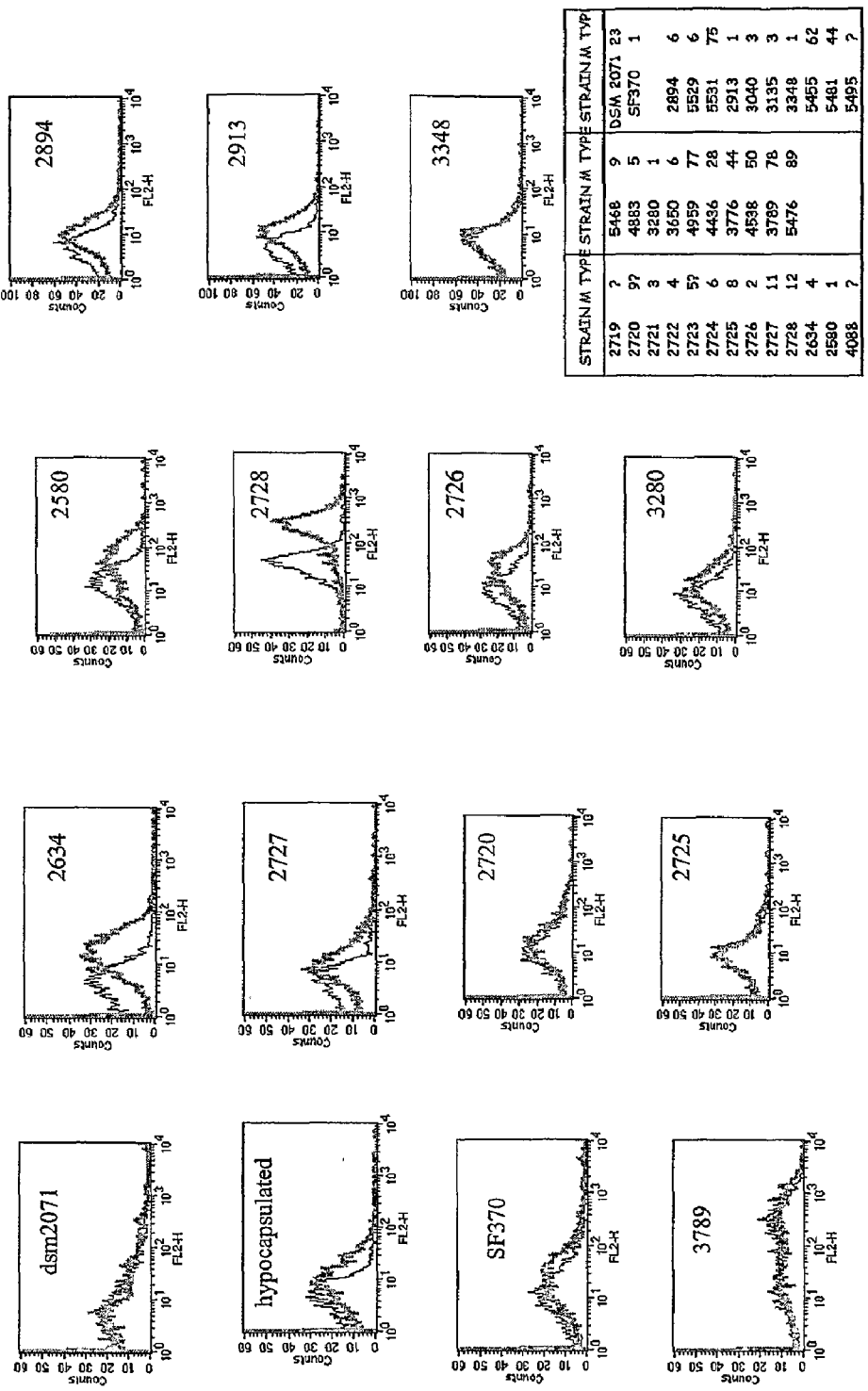
FIG. 3. Results of FACS analysis demonstrating that antisera directed against native GAS40 protein detects GAS40 protein on the cell surface of strains of different M types (strains DSM2071, 2634, a hypocapsulated mutant of DSM2071, 2727, SF370, 2720, 3789, 2725, 2580, 2894, 2728, 2913, 2726, 3348, and 3280).

The invention provides compositions for preventing and/or treating *S. pyogenes* infection. These compositions comprise one or more active agents, which can be GAS antigens expressed on the surface of GAS bacteria, nucleic acid molecules encoding the GAS antigens, and/or antibodies which selectively bind to the GAS antigens.

GAS Antigens

"GAS antigens" according to the invention include (1) naturally occurring immunogenic proteins of a GAS bacterium, (2) immunogenic portions of such proteins, and (3) engineered proteins or portions of proteins with amino acid sequences which retain immunogenicity and which are at least 50% identical to the amino acid sequence of a naturally occurring GAS immunogenic protein or portion thereof, such as homologs, orthologs, allelic variants, and mutants. Depending on the particular sequence, the degree of sequence identity is preferably greater than 50% (e.g., 60%, 70%, 75%, 80%, 85%, 90%, 91%, 92%, 93%, 94%, 95%, 96%, 97%, 98%, 99% or more). Typically, 50% identity or more between two polypeptide sequences is considered to be an indication of functional equivalence. Identity between polypeptides is preferably determined by the Smith-Waterman homology search algorithm as implemented in the MPSRCH program (Oxford Molecular), using an affine gap search with parameters gap open penalty=12 and gap extension penalty=1.

Amino acid sequences for examples of GAS proteins, as well as nucleotide sequences encoding the proteins, are identified in Table 1.

Preferably, a GAS antigen is shorter than a GAS protein by at least one amino acid (e.g., 1, 2, 3, 4, 5, 6, 7, 8, 9, 10, 15, 20, 25, 30, 35, 40, 45, 50, 55, 60, 70, 76, 80, 85, 90, 95, 100, or more amino acids). More preferably a GAS antigen lacks a transmembrane domain. Even more preferably, a GAS antigen comprises a surface-exposed domain.

The invention also includes various polypeptide fragments (including immunogenic portions) of the identified GAS proteins. The length of a fragment may vary depending on the amino acid sequence of the particular GAS antigen. Typically, fragments of GAS proteins comprise at least 7 contiguous amino acids (e.g., 8, 10, 12, 14, 16, 18, 20, 25, 29, 30, 35, 40, 50, 60, 70, 80, 90, 100, 150, 178, 200, 203, 250 or more contiguous amino acids).

Preferably the fragment comprises one or more epitopes. The fragment may comprise at least one T-cell or, preferably, a B-cell epitope of the sequence. T- and B-cell epitopes can be identified empirically (e.g., using PEPSCAN (Geysen et al. (1984) PNAS USA 81:3998-4002; Carter (1994) Methods Mol. Biol. 36:207-223, or similar methods), or they can be predicted (e.g., using the Jameson-Wolf antigenic index (Jameson, B A et al. 1988, CABIOS 4(1):1818-186), matrix-based approaches (Raddrizzani and Hammer (2000) Brief Bioinform. 1(2):179-189), TEPITOPE (De Lalla et al. (199) J. Immunol. 163:1725-1729), neural networks (Brusic et al. (1998) Bioinformatics 14(2):121-130), OptiMer & EpiMer (Meister et al. (1995) Vaccine 13(6):581-591; Roberts et al. (1996) AIDS Res. Hum. Retroviruses 12(7):593-610), ADEPT (Maksyutov & Zagrebelnaya (1993) Comput. Appl. Biosci. 9(3):291-297), Tsites (Feller & de la Cruz (1991) Nature 349(6311):720-721), hydrophilicity (Hopp (1993) Peptide Research 6:183-190), antigenic index (Welling et al. (1985) FEBS Lett. 188:215-218) or the methods disclosed in Davenport et al. (1995) Immunogenetics 42:392-297, etc.

Other preferred fragments include (1) the N-terminal signal peptides of each identified GAS protein, (2) the identified GAS protein without its N-terminal signal peptide, (3) each identified GAS protein wherein up to 10 amino acid residues (e.g., 1, 2, 3, 4, 5, 6, 7, 8, 9, 10, 15, 20, 25 or more) are deleted from the N-terminus and/or the C-terminus, and (4) GAS polypeptides without their N-terminal amino acid residue. Some fragments omit one or more domains of the protein (e.g., omission of a signal peptide, a cytoplasmic domain, a transmembrane domain, and/or an extracellular domain).

Some GAS antigens consist of immunogenic portions of GAS proteins, which can be surface exposed domains as disclosed herein. Other GAS antigens are "hybrid GAS antigens," which comprise one or more immunogenic portions of a full-length GAS protein. Hybrid GAS antigens, which also can include full-length GAS antigens, are described in detail below. Other fusion proteins can comprise, for example, one or more additional antigens and/or a tag protein, such as polyhistidine (HIS) or glutathione-S-transferase (GST).

Preferably, a GAS antigen is expressed on the surface of a GAS bacterium, most preferably on the surface of more than one M type (e.g., 2, 3, 4, 5, 6, 7, 8, or 9 M types), particularly M1, M3, M6, M11, M12, and/or M23 GAS types. GAS antigens also preferably are found on the surface of at least two different strains (e.g., 2, 3, 4, 5, 6, 7, 8, 9, 10, 11, 12, 13, or 14 or more strains). Preferred GAS antigens are highly conserved among multiple M types and/or multiple strains within an M type. See Table 2, which lists full-length GAS proteins and M types on which the proteins are expressed. Columns 3-13 of Table 2 list M types (e.g., M1, M2, etc.). The presence these GAS proteins were detected on the surface of various strains of these M types as explained in Example 1; the number of strains tested within each type is shown in parentheses in columns 3-13. The final column lists the number of strains out of the total of 20 strains tested which express each of these GAS antigens.

As indicated in Table 2, some GAS antigens are expressed on the surface of a number of different M types as well as on the surface of multiple strains within some of these M types. In some embodiments, compositions of the invention comprise one or more GAS antigens which are expressed on the surface of an M1, M3, M6, M11, M12, and/or M23 type. Preferred GAS antigens of this type GAS 5, 99, 166, 96, 103, 188, 76, 108, 142, 190, 22, 56, 77, 67, 75, 93, 18, 23, 69, 206, 249, 123, 143, 68, 25, 30, 97, 105, 187, 195, 242, 81, 101, 6, 62, 49, 63, 85, 89, 100, 179, 205, 291, 98, 104, 36, 92, 158, 178, 218, 175, 78, 131, 29, 82, 91, 165, 327, 219, 60, 86, 380, 207, 271, 74, and 685 antigens. Even more preferably, a GAS antigen is exposed on at least 10 M types (e.g., GAS 5, 22, 40, 56, 67, 76, 77, 96, 99, 103, 108, 142, 166, 188, and 190).

GAS antigens of the invention also include surface-exposed domains of GAS proteins 4, 5, 15, 16, 23, 24, 25, 40, 49, 54, 57, 63, 64, 68, 72, 84, 86, 87, 89, 98, 102, 103, 108, 143, 149, 152, 157, 158, 163, 166, 168, 171, 177, 188, 190, 191, 192, 193, 194, 195, 198, 201, 224, 251, 259, 262, 264, 268, 277, 282, 299, 382, 405, 406, 425, 433, 460, 469, 493, 500, 545, 558, 587, 645, 650, 685, 362-1, spy0080a, spy0272, spy0461, spy0611, spy0717, spy0792, spy1029, spy1073, spy1260, spy1613, spy1835, spy2005, spy2093, spy2178, NT01SP0246, spy0047, spy0127, and spy0686 (see Table 7).

Other GAS antigens include surface-exposed domains of GAS proteins 5, 10, 23, 24, 49, 56, 63, 67, 72, 78, 81, 83, 84, 86, 89, 98, 100, 103, 157, 160, 177, 192, 194, 201, 205, 284, 286, 292, 382, 396, 405, 406, 500, spy0047, spy0053, spy0056, spy0063, spy0069, spy0098, spy0127, spy0274, spy0611, spy0666, spy0686, spy0688, spy0731, spy0913, spy1200, spy1281, spy1721, spy1750, spy1805, spy2070, spy2092, spy2178, and gi-21909751 (see Table 8).

Still others include surface-exposed domains of GAS proteins 16, 57, 68, 143, 158, 166, 171, 188, 190, 191, 192, 23, NT01SP0246, 49, 685, 63, 108, 84, 86, 89, 98, 103, 4, 149, 152, 157, 72, 405, 406, 299, 168, 251, 259, 262, 177, 264, 268, 277, 193, 194, 282, 195, 201, 40, 224, 163, 500, 198, 433, 54, 545, 469, 587, 645, 425, 493, 460, 558, 650, 5, 24, 25, 64, 87, 362-1, 382, 102, NT01SP0485, NT01SP0572, NT01SP0634, and NT01SP0877 (see Table 9).

Some surface-exposed domains are shown in SEQ ID NOS:591-649. Other surface-exposed GAS antigens comprise at least 7 contiguous amino acids selected from the group consisting of SEQ ID NOS:1-281 (i.e., 7, 8, 9, 10, 11, 12, 13, 14, 15, 20, 25, 50, 75, or 100 or more).

GAS antigens also include the surface-exposed domains of GAS proteins 35, 54, 70, 414, 421, 425, 426, 428, 433, 434, 437, 438, 439, 457, 461, 465, 469, 472, 473, 474, 475, 477, 478, 486, 492, 494, 495, 535, 538, 540, 543, 553, 560, 561, 564, 565, 574, 576, 577, 579, 586, 587, 591, 592, 607, 609, 625, 626, 636, 640, 643, 649, 653, 657, and 663. More preferred GAS antigens comprise a surface-exposed domain of 35, 414, 437, 438, 461, 465-2, 469, 472, 473, 475, 478, 495, 538, 553, 561, 577-2, 591, 593, 636, 643, 649, or 663. Even more preferred surface-exposed GAS antigens comprise a surface-exposed domain of GAS472, GAS473, or GAS553.

Other useful GAS antigens include GAS117, GAS130, GAS277, GAS236, GAS389, GAS504, GAS509, GAS366, GAS159, GAS217, GAS309, GAS372, GAS039, GAS042, GAS058, GAS290, GAS511, GAS533, GAS527, GAS294, GAS253, GAS529, GAS045, GAS095, GAS193, GAS137, GAS084, GAS384, GAS202, and GAS057 antigens, as well as M protein, GAS fibronectin-binding protein, GAS streptococcal heme-associated protein, and streptolysin S antigens.

Preferred groups of GAS antigens for use in vaccines of the present invention include:
(i) GAS4, GAS24, GAS54, GAS63, GAS64, GAS72, GAS86, GAS87, GAS102, GAS149, GAS152, GAS157, GAS163, GAS168, GAS171, GAS177, GAS191, GAS192, GAS194, GAS198, GAS201, GAS224, GAS251, GAS259, GAS262, GAS264, GAS268, GAS282, GAS299, GAS382, GAS405, GAS406, GAS425, GAS433, GAS460, GAS469, GAS493, GAS500, GAS545, GAS558, GAS587, GAS645, GAS650, GAS685, GAS362-1, spy611, spy717, spy792, spy1073, NT01SP0246, and NT01SP0102;

(ii) GAS64, GAS149, GAS158, GAS166, GAS191, GAS192, GAS193, SPY1664, and SPY0861;

(iii) GAS57, GAS64, GAS72, GAS84, GAS98, GAS108, GAS152, GAS157, GAS158, GAS166, GAS191, GAS192, GAS193, GAS268, NT01SP0246, NT01SP0908 (Spy1111), and NT01SP0182 (Spy0216);

(iv) GAS64, GAS158, GAS166, GAS191, GAS192, and GAS193; and (v) GAS5, GAS6, GAS15, GAS16p2, GAS18, GAS22, GAS23, GAS25, GAS29, GAS30, GAS36, GAS40a-RR, GAS42, GAS45, GAS49, GAS56, GAS57, GAS60, GAS62, GAS63, GAS65, GAS67, GAS68, GAS69, GAS75, GAS76, GAS77, GAS81, GAS82, GAS84, GAS85, GAS86, GAS88, GAS89, GAS91, GAS92, GAS94, GAS95, GAS96, GAS97, GAS98, M30098, GAS99, GAS100, M3_0100, GAS101, M3_0102, GAS103, M3_0104, GAS105, SPs0106, GAS108, GAS117-40+A97, GAS130, GAS137, GAS142, GAS143, M6_0157, GAS158, M6_0159, GAS159a, M6_0160, GAS165, GAS166, GAS175, GAS178, GAS179-1, GAS187, GAS188, GAS190, GAS191, GAS193, GAS195, GAS205-1, GAS206, GAS208, GAS217, GAS218, GAS218-t, GAS219-1, GAS220, GAS242, GAS249, GAS277a, GAS290, GAS294-1, GAS327, GAS380, GAS384-RR, GAS504, GAS509, GAS511, GAS527, GAS529, GAS533, GAS680, 19224134, 19224135, 19224137, and 19224141 (see Table 16).

GAS 680 is annotated as a predicted CoA-binding protein and corresponds to M1 GenBank accession numbers GI:13621481 and GI:71909974, to M49 GenBank accession number GI:56808534, to M18 GenBank accession number GI:19747454, to M3 GenBank accession number GI: 28895062, and is also referred to as 'Spy0186' or 'M5005_Spy_0160' (M1), 'SpyoM01000450' (M49), 'spyM18_0185' (M18) and 'SPs0150' (M3).

GAS vaccines of the invention preferably include all or a surface portion of GAS57 and/or GAS40.

GAS40 Antigens

GAS40 antigens are particularly useful in compositions of the invention because GAS40 proteins are highly conserved both in many M types and in multiple strains of these M types (see FIG. 1). GAS40 proteins are described in detail in WO 05/032582. See also FIG. 15. GAS40 consistently provides protection in the animal model of systemic immunization and challenge and induction of bactericidal antibodies (see the specific Examples, below). GAS40 is an extremely highly conserved protein and appears to be exposed on the surface of most M serotypes (the only exception observed thus far is the M3 serotype).

Amino acid sequences of a number of GAS40 proteins from various M strains are provided in SEQ ID NOS:17-43. The amino acid sequences of several GAS40 proteins also are contained in GenBank and have accession numbers GI:13621545 and GI:15674449 (M1); accession number GI: 21909733 (M3), and accession number GI:19745402 (M18). GAS40 proteins also are known as "Spy0269" (M1), "SpyM3_0197" (M3), "SpyM18_0256" (M18) and "prgA."

A GAS40 protein typically contains a leader peptide sequence (e.g., amino acids 1-26 of SEQ ID NO:17), a first coiled-coil region (e.g., amino acids 58-261 of SEQ ID NO:17), a second coiled coil region (e.g., amino acids 556-733 of SEQ ID NO:17), a leucine zipper region (e.g., amino acids 673-701 of SEQ ID NO:17) and a transmembrane region (e.g., amino acids 855-866 of SEQ ID NO:17).

Preferred fragments of a GAS40 protein lack one or more amino acids (e.g., 1, 2, 3, 4, 5, 6, 7, 8, 9, 10, 15, 20, 25 or more) from the C-terminus and/or one or more amino acids (e.g., 1, 2, 3, 4, 5, 6, 7, 8, 9, 10, 15, 20, 25 or more) from the N-terminus of the GAS40 protein. In one embodiment, the leader sequence is removed. In another embodiment, the transmembrane region is removed. Other fragments may omit one or more other domains of the GAS40 protein.

The coiled-coil regions of GAS40 are likely involved in the formation of oligomers such as dimers or trimers. Such oligomers could be homomers (containing two or more GAS40 proteins oligomerized together) or heteromers (containing one or more additional GAS proteins oligomerized with GAS40). Alternatively, two coiled-coil regions may interact together within the GAS40 protein to form oligomeric reactions between the first and second coiled-coil regions. Thus, in some embodiments the GAS40 antigen is in the form of an oligomer. Some oligomers comprise two more GAS40 antigens. Other oligomers comprise a GAS40 antigen oligomerized to a second GAS antigen.

Other useful GAS antigens include fusion proteins comprising GAS40 and GAS117. "40/117" is a GAS40 hybrid antigen in which the GAS 40 protein is placed to the N-terminus of the GAS117 protein and a HIS tag is added to the C terminus of the GAS117 protein (SEQ ID NO:234). "117/40" is a GAS40 hybrid antigen in which GAS117 is fused to GAS40 by the linker sequence YASGGGS (SEQ ID NO:278). Its amino acid sequence is shown in SEQ ID NO:233.

"GAS40a-HIS" is a GAS40 antigen with a HIS tag but without the leader and hydrophobic sequences (SEQ ID NO:235). A nucleotide sequence encoding GAS40a is shown in SEQ ID NO:892 (codon 824, AGA in the wild-type sequence, was mutagenized to CGT). "GAS40aRR" is similar to GAS40a except that two additional AGA codons (334 and 335) in the coding sequence were mutated to CGT.

Hybrid GAS Antigens

GAS antigens can be present in compositions of the invention as individual separate polypeptides. Alternatively, at least two (e.g., 2, 3, 4, 5, 6, 7, 8, 9, 10, 11, 12, 13, 14, 15, 16, 17, 18, 19 or 20) of any of the GAS antigens described above can be expressed as a single polypeptide chain, i.e., a "hybrid GAS antigen." Hybrid GAS antigens offer two principal advantages. First, a polypeptide which may be unstable or poorly expressed on its own can be assisted by adding a suitable hybrid partner which overcomes the problem. Second, commercial manufacture is simplified because only one expression and purification produces two polypeptides, both of which are antigenically useful.

A hybrid GAS antigen can comprise two or more amino acid sequences for GAS40 antigens and/or one or more other GAS antigens of the invention. Hybrids can comprise amino acid sequences from two, three, four, five, six, seven, eight, nine, or ten or more GAS antigens. In compositions of the invention, a GAS antigen can be present in more than one hybrid GAS antigen and/or as a non hybrid GAS antigen.

A hybrid GAS antigen comprises at least two GAS antigens (e.g., 1, 2, 3, 4, 5, 6, 7, 8, 9, 10, 11, 12, 13, 14, 15, 16, 17, 18, 19 or 20) expressed as a single polypeptide chain. Preferred hybrid GAS antigens comprise at least one surface-exposed and/or surface-associated GAS antigen. Hybrid GAS antigens offer two principal advantages. First, a polypeptide which may be unstable or poorly expressed on its own can be assisted by adding a suitable hybrid partner which overcomes the problem. Second, commercial manufacture is simplified because only one expression and purification produces two polypeptides, both of which are antigenically useful.

Hybrid GAS antigens can be represented by the formula:

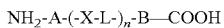

$$NH_2\text{-}A\text{-}(\text{-}X\text{-}L\text{-})_n\text{-}B\text{—}COOH$$

in which X is an amino acid sequence of a surface-exposed and/or surface-associated or secondary GAS antigen; L is an optional linker amino acid sequence; A is an optional N-terminal amino acid sequence; B is an optional C-terminal amino acid sequence; and n is 2, 3, 4, 5, 6, 7, 8, 9, 10, 11, 12, 13, 14 or 15.

If an —X— moiety has a leader peptide sequence in its wild-type form, this may be included or omitted in the hybrid antigen. In some embodiments, the leader peptides will be deleted except for that of the —X— moiety located at the N-terminus of the hybrid protein i.e. the leader peptide of $X_1$ will be retained, but the leader peptides of $X_2 \ldots X_n$ will be omitted. This is equivalent to deleting all leader peptides and using the leader peptide of $X_1$ as moiety -A-.

For each n instances of (—X-L-), linker amino acid sequence -L- may be present or absent. For instance, when n=2 the hybrid may be $NH_2$—$X_1$-$L_1$-$X_2$-$L_2$-COOH, $NH_2$—$X_1$—$X_2$—COOH, $NH_2$—$X_1$-$L_1$-$X_2$—COOH, $NH_2$—$X_1$—$X_2$-$L_2$-COOH, etc. Linker amino acid sequence(s)-L- will typically be short, e.g., 20 or fewer amino acids (i.e., 20, 19, 18, 17, 16, 15, 14, 13, 12, 11, 10, 9, 8, 7, 6, 5, 4, 3, 2, 1). Examples include short peptide sequences which facilitate cloning, poly-glycine linkers (Gly, where n=2, 3, 4, 5, 6, 7, 8, 9, 10 or more), and histidine tags ($His_n$ where n=3, 4, 5, 6, 7, 8, 9, 10 or more). Other suitable linker amino acid sequences will be apparent to those skilled in the art. A useful linker is GSGGGG (SEQ ID NO:280), with the Gly-Ser dipeptide being formed from a BamHI restriction site, which aids cloning and manipulation, and the $(Gly)_4$ tetrapeptide being a typical poly-glycine linker.

-A- is an optional N-terminal amino acid sequence. This will typically be short, e.g., 40 or fewer amino acids (i.e., 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking or short peptide sequences which facilitate cloning or purification (e.g., a histidine tag His, where n=3, 4, 5, 6, 7, 8, 9, 10 or more). Other suitable N-terminal amino acid sequences will be apparent to those skilled in the art. If $X_1$ lacks its own N-terminus methionine, -A- is preferably an oligopeptide (e.g., with 1, 2, 3, 4, 5, 6, 7 or 8 amino acids) which provides a N-terminus methionine.

—B— is an optional C-terminal amino acid sequence. This will typically be short, e.g., 40 or fewer amino acids (i.e., 40, 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include sequences to direct protein trafficking, short peptide sequences which facilitate cloning or purification (e.g., $His_n$ where n=3, 4, 5, 6, 7, 8, 9, 10 or more), or sequences which enhance protein stability. Other suitable C-terminal amino acid sequences will be apparent to those skilled in the art.

The individual GAS antigens within the hybrid (individual —X— moieties) may be from one or more strains or from one or more M types. Where n=2, for instance, $X_2$ may be from the same strain or type as $X_1$ or from a different strain or type. Where n=3, the strains might be (i) $X_1=X_2=X_3$, (ii) $X_1=X_2\neq X_3$, (iii) $X_1\neq X_2=X_3$, (iv) $X_1\neq X_2/X_3$, or (v) $X_1=X_3\neq X_2$, etc.

Identification of Surface-Exposed GAS Antigens

Surface-exposed and/or surface-associated GAS antigens (GAS "surfome") can be identified using any one or combination of several proteomics approaches as outlined below. These proteomics strategies have great potential for shortening the time needed for vaccine discovery when compared with other strategies, such as reverse vaccinology. Surface-exposed and/or surface-associated GAS antigens identified by these methods can be used as active agents in compositions for preventing and for treating *S. pyogenes* infections.

One embodiment is described in Example 13. Briefly, the surface of whole GAS bacterial cells is digested in vivo under physiological conditions using reagents which cleave proteins. Typically the reagents are proteases (e.g., trypsin, protease K, papain), although any protein cleavage reagent can be used. These reagents include, for example, formic acid, hydroxylamine, BNPS-skatole (3-bromo-3-methyl-2-(o-nitrophenyl-sulfenyl)-indolenine), which cleaves at Trp residues), cyanogen bromide (which cleaves polypeptides on the carboxyl side of methionine residues), metal chelate reagents such as Fe-EDTA, and the like. Proteases can be either free or anchored, this latter condition favouring the identification of surface extruding regions. Combinations of more than one protein cleavage reagent can be used. The recovered peptides are then separated by liquid chromatography and identified by tandem mass spectrometry. The actual accessibility of identified proteins to the immune system can be assessed by fluorescence-activated cell sorting (FACS) analysis. This proteomic approach permits validation of software-based topology predictions and vice versa.

Another embodiment is described in Example 14. This approach involves overproduction of membrane-delimited from GAS bacteria after antibiotic treatment. See Hakenbeck et al., J. Bacteriol. 155, 1372-81, 1983, which is incorporated herein by reference. Either wild-type GAS bacteria or mutant GAS bacteria, for example those with "leaky" or destabilized peptidoglycan cell walls, can be used in this method. GAS bacteria naturally produce membrane-delimited structures which are released into the growth medium. When the bacteria are treated with an antibiotic that interferes with the synthesis of the cell-wall such as penicillins, cephalosporins, glycopeptides and cycloserine, production of these membrane-delimited structures increases. Vancomycin, a glycopeptide which inhibits both cell wall synthesis and the sortase, interferes with surface protein anchoring which is catalyzed by sortases and can be used to further increase the overproduction of membrane-delimited structures. The membrane-delimited structures contain GAS proteins which are potential vaccine candidates. The GAS proteins can be separated by electrophoresis and identified using mass spectrometry (e.g., MALDI-TOF). Alternatively, the GAS proteins can be digested with proteases, and the resulting fragments can be separated by liquid chromatography and identified using tandem mass spectrometry.

A third embodiment is described in Example 15. In this method, cell wall and/or membrane fractions are generated by chemical cell fractionation of bacterial cells using, for example, 6 M guanidinium, urea, or SDS. The cell wall is insoluble in these reagents. This property allows the isolation of the cell wall and identification of anchored cell wall proteins. GAS proteins in these fractions can be separated and identified as described above.

A fourth embodiment involves labeling cell surface GAS proteins (e.g., by biotinylation), lysing the cells, and isolating labeled proteins using affinity chromatography. The isolated proteins can be separated by electrophoresis and identified using mass spectrometry. Alternatively, the isolated proteins can be digested in solution, followed by isolation of labeled peptides by affinity chromatography, separation of the labeled peptides by liquid chromatography, and identification of the labeled peptides using tandem mass spectrometry. These methods selectively isolate the labeled peptides, therefore they allow identification of the truly exposed domains. In this case, the use of two affinity chromatography steps results in a reduction of complexity of the sample to be loaded on the chromatography column.

For all the above embodiments a mutant can be used which harbors a deleted gene for one of the more abundant known surface-exposed antigens, such as M protein and C5a peptidase. These mutants will increase the probability of spotting previously unidentified, less abundant surface proteins.

Analysis of the bacterial surfome provides powerful methods of identifying antigens useful in vaccines against S. pyogenes. For example, using these techniques, as described below, we identified a protein, Spy0416 (GAS57), which confers a remarkable protection in mice against the highly virulent M3 (MGAS315) strain. Spy0416 is a 1647 amino acid protein, carrying a C-terminal LPXTG-like motif, which shares 48% similarity with the C5a peptidase precursor. See SEQ ID NO:118. The protein has a Ca-dependent serine protease activity (Femandez-Espla, App. Env. Microbiol., 2000) which maps within the first 600 amino acids of the protein. Spy0416 has a homolog in Group B Streptococcus (GBS) (cspA) which was proposed to be involved in GBS virulence by potentially protecting the bacterium from opsonophagocytic killing (Harris et al., J. Clin. Invest. 111, 61-70, 2003). Lei and co-workers recently found that a 31 kDa N-terminal fragment of Spy0416 is released in the supernatant of GAS cultures and that the protein is well recognized by sera from GAS-infected patients (Lei et al, Inf. Immunol. 68, 6807-18, 2000). Based on the 5 available Streptococcus pyogenes genome sequences, the protein appears to be highly conserved (over 98%) and preliminary data on surface expression on a panel of 20 different GAS strains indicates that Spy0416 is a major component of over 70% of the circulating strains. It is, therefore, a preferred antigen for use in immunogenic compositions, either alone or in combination with one or more other GAS antigens.

Nucleic Acid Molecules

The sequence listing provides coding sequences for the surface-exposed and/or surface-associated domains disclosed herein and their full-length proteins, as well as for the additional disclosed secondary GAS antigens. Any nucleotide sequence which encodes a particular antigen, however, can be used in a compositions of the invention, for example as a DNA vaccine, or to produce a GAS antigen recombinantly, as described below. The full genomic sequences of at least three GAS strains are publicly available and can be used to obtain coding sequences for GAS antigens. The genomic sequence of an M1 GAS strain is reported in Ferretti et al., Proc. Natl. Acad. Sci. U.S.A. 98, 4658-63, 2002. The genomic sequence of an M3 GAS strain is reported in Beres et al., Proc. Natl. Acad. Sci. U.S.A. 99, 10078-83, 2002. The genomic sequence of an M18 GAS strain is reported in Smooet et al., Proc. Natl. Acad. Sci. U.S.A. 99, 4668-73, 2002.

The invention includes nucleic acid molecules which encode the identified GAS proteins and protein fragments. The invention also includes nucleic acid molecules comprising nucleotide sequences having at least 50% sequence identity to such molecules. Depending on the particular sequence, the degree of sequence identity is preferably greater than 50% (e.g., 60%, 70%, 75%, 80%, 85%, 90%, 91%, 92%, 93%, 94%, 95%, 96%, 97%, 98%, 99% or more). Identity between nucleotide sequences is preferably determined by the Smith-Waterman homology search algorithm as implemented in the MPSRCH program (Oxford Molecular), using an affine gap search with parameters gap open penalty=12 and gap extension penalty=1.

The invention also provides nucleic acid molecules which can hybridize to these molecules. Hybridization reactions can be performed under conditions of different "stringency." Conditions which increase stringency of a hybridization reaction are widely known and published in the art. See, e.g., page 7.52 of Sambrook et al., Molecular Cloning: A Laboratory Manual, 1989. Examples of relevant conditions include (in order of increasing stringency): incubation temperatures of 25° C., 37° C., 50° C., 55° C., and 68° C.; buffer concentrations of 10×SSC, 6×SSC, 1×SSC, and 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art. See, e.g., Sambrook, 1989; Ausubel et al., eds., Short Protocols in Molecular Biology, 4th ed., 1999; U.S. Pat. No. 5,707,829; Ausubel et al., eds., Current Protocols in Molecular Biology, Supplement 30, 1987.

In some embodiments, nucleic acid molecules of the invention hybridize to a target under low stringency conditions; in other embodiments, nucleic acid molecules of the invention hybridize under intermediate stringency conditions; in preferred embodiments, nucleic acid molecules of the invention hybridize under high stringency conditions. An example of a low stringency hybridization condition is 50° C. and 10×SSC. An example of an intermediate stringency hybridization condition is 55° C. and 1×SSC. An example of a high stringency hybridization condition is 68° C. and 0.1×SSC.

Nucleic acid molecules comprising fragments of these sequences are also included in the invention. These comprise at least n consecutive nucleotides of these sequences and, depending on the particular sequence, n is 10 or more (e.g., 12, 14, 15, 18, 20, 25, 30, 35, 40, 50, 60, 70, 80, 90, 100, 150, 200, or more).

Nucleic acids (and polypeptides) of the invention may include sequences which:

(a) are identical (i.e., 100% identical) to the sequences disclosed in the sequence listing;

(b) share sequence identity with the sequences disclosed in the sequence listing;

(c) have 1, 2, 3, 4, 5, 6, 7, 8, 9, or 10 single nucleotide or amino acid alterations (deletions, insertions, substitutions), which may be at separate locations or may be contiguous, as compared to the sequences of (a) or (b); and, d) when aligned with a particular sequence from the sequence listing using a pairwise alignment algorithm, a moving window of x monomers (amino acids or nucleotides) moving from start (N-terminus or 5') to end (C-terminus or 3'), such that for an alignment that extends to p monomers (where p>x) there are p−x+1 such windows, each window has at least x·y identical aligned monomers, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. The preferred pairwise alignment algorithm is the Needleman-Wunsch global alignment algorithm [Needleman & Wunsch (1970) J. Mol. Biol. 48, 443-453], using default parameters (e.g., with Gap opening penalty=10.0, and with Gap extension penalty=0.5, using the EBLOSUM62 scoring matrix). This algorithm is conveniently implemented in the needle tool in the EMBOSS package [Rice et al. (2000) Trends Genet. 16:276-277].

The nucleic acids and polypeptides of the invention may additionally have further sequences to the N-terminus/5' and/or C-terminus/3' of these sequences (a) to (d).

Antibodies

Antibodies can be generated to bind specifically to a surface-exposed and/or surface-associated GAS antigen or to a secondary GAS or non-GAS polypeptide antigen disclosed herein. The term "antibody" includes intact immunoglobulin molecules, as well as fragments thereof which are capable of binding an antigen. These include hybrid (chimeric) antibody molecules (e.g., Winter et al., Nature 349, 293-99, 1991; U.S. Pat. No. 4,816,567); F(ab')2 and F(ab) fragments and Fv molecules; non-covalent heterodimers (e.g., Inbar et al., Proc. Natl. Acad. Sci. U.S.A. 69, 2659-62, 1972; Ehrlich et al., Biochem 19, 4091-96, 1980); single-chain Fv molecules (sFv) (e.g., Huston et al., Proc. Natl. Acad. Sci. U.S.A. 85, 5897-83, 1988); dimeric and trimeric antibody fragment constructs; minibodies (e.g., Pack et al., Biochem 31, 1579-84, 1992; Cumber et al., J. Immunology 149B, 120-26, 1992); humanized antibody molecules (e.g., Riechmann et al., Nature 332, 323-27, 1988; Verhoeyan et al., Science 239, 1534-36, 1988; and U.K. Patent Publication No. GB 2,276, 169, published 21 Sep. 1994); and any functional fragments obtained from such molecules, as well as antibodies obtained through non-conventional processes such as phage display. Preferably, the antibodies are monoclonal antibodies. Methods of obtaining monoclonal antibodies are well known in the art.

Typically, at least 6, 7, 8, 10, or 12 contiguous amino acids are required to form an epitope. However, epitopes which involve non-contiguous amino acids may require more, e.g., at least 15, 25, or 50 amino acids. Various immunoassays (e.g., Western blots, ELISAs, radioimmunoassays, immunohistochemical assays, immunoprecipitations, or other immunochemical assays known in the art) can be used to identify antibodies having the desired specificity. Numerous protocols for competitive binding or immunoradiometric assays are well known in the art. Such immunoassays typically involve the measurement of complex formation between an immunogen and an antibody which specifically binds to the immunogen. A preparation of antibodies which specifically bind to a particular antigen typically provides a detection signal at least 5-, 10-, or 20-fold higher than a detection signal provided with other proteins when used in an immunochemical assay. Preferably, the antibodies do not detect other proteins in immunochemical assays and can immunoprecipitate the particular antigen from solution.

Generation of Antibodies

GAS antigens or non-GAS polypeptide antigens (described below) can be used to immunize a mammal, such as a mouse, rat, rabbit, guinea pig, monkey, or human, to produce polyclonal antibodies. If desired, an antigen can be conjugated to a carrier protein, such as bovine serum albumin, thyroglobulin, and keyhole limpet hemocyanin. Depending on the host species, various adjuvants can be used to increase the immunological response. Such adjuvants include, but are not limited to, Freund's adjuvant, mineral gels (e.g., aluminum hydroxide), and surface active substances (e.g. lysolecithin, pluronic polyols, polyanions, peptides, oil emulsions, keyhole limpet hemocyanin, and dinitrophenol). Among adjuvants used in humans, BCG (bacilli Calmette-Guerin) and *Corynebacterium parvum* are especially useful.

Monoclonal antibodies which specifically bind to an antigen can be prepared using any technique which provides for the production of antibody molecules by continuous cell lines in culture. These techniques include, but are not limited to, the hybridoma technique, the human B cell hybridoma technique, and the EBV hybridoma technique (Kohler et al., Nature 256, 495 497, 1985; Kozbor et al., J. Immunol. Methods 81, 3142, 1985; Cote et al., Proc. Natl. Acad. Sci. 80, 2026 2030, 1983; Cole et al., Mol. Cell. Biol. 62, 109 120, 1984).

In addition, techniques developed for the production of "chimeric antibodies," the splicing of mouse antibody genes to human antibody genes to obtain a molecule with appropriate antigen specificity and biological activity, can be used (Morrison et al., Proc. Natl. Acad. Sci. 81, 68516855, 1984; Neuberger et al., Nature 312, 604 608, 1984; Takeda et al., Nature 314, 452 454, 1985). Monoclonal and other antibodies also can be "humanized" to prevent a patient from mounting an immune response against the antibody when it is used therapeutically. Such antibodies may be sufficiently similar in sequence to human antibodies to be used directly in therapy or may require alteration of a few key residues. Sequence differences between rodent antibodies and human sequences can be minimized by replacing residues which differ from those in the human sequences by site directed mutagenesis of individual residues or by grating of entire complementarity determining regions.

Alternatively, humanized antibodies can be produced using recombinant methods, as described below. Antibodies which specifically bind to a particular antigen can contain antigen binding sites which are either partially or fully humanized, as disclosed in U.S. Pat. No. 5,565,332.

Alternatively, techniques described for the production of single chain antibodies can be adapted using methods known in the art to produce single chain antibodies which specifically bind to a particular antigen. Antibodies with related specificity, but of distinct idiotypic composition, can be generated by chain shuffling from random combinatorial immunoglobin libraries (Burton, Proc. Natl. Acad. Sci. 88, 11120 23, 1991).

Single-chain antibodies also can be constructed using a DNA amplification method, such as PCR, using hybridoma cDNA as a template (Thirion et al., 1996, Eur. J. Cancer Prev. 5, 507-11). Single-chain antibodies can be mono- or bispecific, and can be bivalent or tetravalent. Construction of tetravalent, bispecific single-chain antibodies is taught, for example, in Coloma & Morrison, 1997, Nat. Biotechnol. 15, 159-63. Construction of bivalent, bispecific single-chain antibodies is taught in Mallender & Voss, 1994, J. Biol. Chem. 269, 199-206.

A nucleotide sequence encoding a single-chain antibody can be constructed using manual or automated nucleotide synthesis, cloned into an expression construct using standard recombinant DNA methods, and introduced into a cell to express the coding sequence, as described below. Alternatively, single-chain antibodies can be produced directly using, for example, filamentous phage technology (Verhaar et al., 1995, Int. J. Cancer 61, 497-501; Nicholls et al., 1993, J. Immunol. Meth. 165, 81-91).

Antibodies which specifically bind to a particular antigen also can be produced by inducing in vivo production in the lymphocyte population or by screening immunoglobulin libraries or panels of highly specific binding reagents as disclosed in the literature (Orlandi et al., Proc. Natl. Acad. Sci. 86, 3833 3837, 1989; Winter et al., Nature 349, 293 299, 1991).

Chimeric antibodies can be constructed as disclosed in WO 93/03151. Binding proteins which are derived from immunoglobulins and which are multivalent and multispecific, such as the "diabodies" described in WO 94/13804, also can be prepared.

Antibodies can be purified by methods well known in the art. For example, antibodies can be affinity purified by passage over a column to which the relevant antigen is bound. The bound antibodies can then be eluted from the column using a buffer with a high salt concentration.

Production of Polypeptide Antigens

Recombinant Production of Polypeptides

Any nucleotide sequence which encodes a particular antigen can be used to produce that antigen recombinantly. If desired, an antibody can be produced recombinantly once its amino acid sequence is known.

Examples of sequences which can be used to produce GAS antigens of the invention are identified in Table 1. Nucleic acid molecules encoding surface-exposed and/or surface-associated or secondary GAS antigens can be isolated from the appropriate S. pyogenes bacterium using standard nucleic acid purification techniques or can be synthesized using an amplification technique, such as the polymerase chain reaction (PCR), or by using an automatic synthesizer. Methods for isolating nucleic acids are routine and are known in the art. Any such technique for obtaining nucleic acid molecules can be used to obtain a nucleic acid molecule which encodes a particular antigen. Sequences encoding a particular antigen or antibody can be synthesized, in whole or in part, using chemical methods well known in the art (see Caruthers et al., Nucl. Acids Res. Symp. Ser. 215 223, 1980; Horn et al. Nucl. Acids Res. Symp. Ser. 225 232, 1980).

cDNA molecules can be made with standard molecular biology techniques, using mRNA as a template. cDNA molecules can thereafter be replicated using molecular biology techniques well known in the art. An amplification technique, such as PCR, can be used to obtain additional copies of polynucleotides of the invention, using either genomic DNA or cDNA as a template.

If desired, nucleotide sequences can be engineered using methods generally known in the art to alter antigen-encoding sequences for a variety of reasons, including but not limited to, alterations which modify the cloning, processing, and/or expression of the polypeptide or mRNA product. DNA shuffling by random fragmentation and PCR reassembly of gene fragments and synthetic oligonucleotides can be used to engineer the nucleotide sequences. For example, site directed mutagenesis can be used to insert new restriction sites, alter glycosylation patterns, change codon preference, produce splice variants, introduce mutations, and so forth.

Sequence modifications, such as the addition of a purification tag sequence or codon optimization, can be used to facilitate expression. For example, the N-terminal leader sequence may be replaced with a sequence encoding for a tag protein such as polyhistidine ("HIS") or glutathione S-transferase ("GST"). Such tag proteins may be used to facilitate purification, detection, and stability of the expressed protein. Codons preferred by a particular prokaryotic or eukaryotic host can be selected to increase the rate of protein expression or to produce an RNA transcript having desirable properties, such as a half life which is longer than that of a transcript generated from the naturally occurring sequence. These methods are well known in the art and are further described in WO05/032582.

Expression Vectors

A nucleic acid molecule which encodes an antigen or antibody can be inserted into an expression vector which contains the necessary elements for the transcription and translation of the inserted coding sequence. Methods which are well known to those skilled in the art can be used to construct expression vectors containing coding sequences and appropriate transcriptional and translational control elements. These methods include in vitro recombinant DNA techniques, synthetic techniques, and in vivo genetic recombination.

Host Cells

The heterologous host can be prokaryotic or eukaryotic. E. coli is a preferred host cell, but other suitable hosts include Lactococcus lactis, Lactococcus cremoris, Bacillus subtilis, Vibrio cholerae, Salmonella typhi, Salmonella typhimurium, Neisseria lactamica, Neisseria cinerea, Mycobacteria (e.g., M. tuberculosis), yeasts, etc.

A host cell strain can be chosen for its ability to modulate the expression of the inserted sequences or to process the expressed polypeptide in the desired fashion. Such modifications of the polypeptide include, but are not limited to, acetylation, carboxylation, glycosylation, phosphorylation, lipidation, and acylation. Post translational processing which cleaves a "prepro" form of the polypeptide also can be used to facilitate correct insertion, folding and/or function. Different host cells which have specific cellular machinery and characteristic mechanisms for post translational activities are available from the American Type Culture Collection (ATCC; 10801 University Boulevard, Manassas, Va. 20110-2209) and can be chosen to ensure the correct modification and processing of a foreign protein. See WO 01/98340.

Expression constructs can be introduced into host cells using well-established techniques which include, but are not limited to, transferrin-polycation-mediated DNA transfer, transfection with naked or encapsulated nucleic acids, liposome-mediated cellular fusion, intracellular transportation of DNA-coated latex beads, protoplast fusion, viral infection, electroporation, "gene gun" methods, and DEAE- or calcium phosphate-mediated transfection.

Host cells transformed with expression vectors can be cultured under conditions suitable for the expression and recovery of the protein from cell culture. The protein produced by a transformed cell can be secreted or contained intracellularly depending on the nucleotide sequence and/or the expression vector used. Those of skill in the art understand that expression vectors can be designed to contain signal sequences which direct secretion of soluble antigens through a prokaryotic or eukaryotic cell membrane.

Purification

Antigens used in the invention can be isolated from the appropriate Streptococcus pyogenes bacterium or from a host cell engineered to produce GAS or non-GAS antigens. A purified polypeptide antigen is separated from other components in the cell, such as proteins, carbohydrates, or lipids, using methods well-known in the art. Such methods include, but are not limited to, size exclusion chromatography, ammonium sulfate fractionation, ion exchange chromatography, affinity chromatography, and preparative gel electrophoresis. A preparation of purified polypeptide antigens is at least 80% pure; preferably, the preparations are 90%, 95%, or 99% pure. Purity of the preparations can be assessed by any means known in the art, such as SDS-polyacrylamide gel electrophoresis. Where appropriate, polypeptide antigens can be solubilized, for example, with urea.

Chemical Synthesis

GAS antigens, as well as other antigens used in compositions of the invention, can be synthesized, for example, using solid phase techniques. See, e.g., Merrifield, J. Am. Chem. Soc. 85, 2149 54, 1963; Roberge et al., Science 269, 202 04, 1995. Protein synthesis can be performed using manual techniques or by automation. Automated synthesis can be achieved, for example, using Applied Biosystems 431A Peptide Synthesizer (Perkin Elmer). Optionally, fragments of a surface-exposed and/or surface-associated GAS antigen can be separately synthesized and combined using chemical methods to produce a full-length molecule.

Nucleic acid molecules which encode antibodies or polypeptide antigens can be synthesized by conventional methodology, such as the phosphate triester method (Hunkapiller, M. et al. (1984), Nature 310: 105-111) or by the chemical synthesis of nucleic acids (Grantham, R. et al. (1981), Nucleic Acids Res. 9: r43-r74).

Immunogenic, Diagnostic, and Therapeutic Compositions

The invention also provides compositions for use as medicaments (e.g., as immunogenic compositions or vaccines) or as diagnostic reagents for detecting a GAS infection in a host subject. It also provides the use of the compositions in the manufacture of: (i) a medicament for treating or preventing infection due to GAS bacteria; (ii) a diagnostic reagent for detecting the presence of GAS bacteria or of antibodies raised against GAS bacteria; and/or (iii) a reagent which can raise antibodies against GAS bacteria.

For example, GAS antigens or nucleic acids encoding the antigens can be used in the manufacture of a diagnostic reagent for detecting the presence of a GAS infection or for detecting antibodies raised against GAS bacteria, or in the manufacture of a reagent which can raise antibodies against GAS bacteria. Nucleic acids encoding GAS antigens can be detected by contacting a nucleic acid probe with a biological sample under hybridizing conditions to form duplexes and detecting the duplexes as is known in the art. A GAS antigen can be detected using antibodies which specifically bind to the GAS antigen. Similarly, antibodies to GAS antigens can be used to detect GAS antigens by contacting a biological sample under conditions suitable for the formation of antibody-antigen complexes and detecting any complexes formed. The invention also provides kits comprising reagents suitable for use these methods.

Therapeutic Compositions

Compositions of the invention are useful for preventing and/or treating S. pyogenes infection. Compositions containing GAS antigens are preferably immunogenic compositions, and are more preferably vaccine compositions. The pH of such compositions preferably is between 6 and 8, preferably about 7. The pH can be maintained by the use of a buffer. The composition can be sterile and/or pyrogen free. The composition can be isotonic with respect to humans.

Vaccines according to the invention may be used either prophylactically or therapeutically, but will typically be prophylactic. Accordingly, the invention includes a method for the therapeutic or prophylactic treatment of a Streptococcus pyogenes infection. The animal is preferably a mammal, most preferably a human. The methods involve administering to the animal a therapeutic or prophylactic amount of the immunogenic compositions of the invention.

Some compositions of the invention comprise at least two surface-exposed GAS antigens as described above. Other compositions of the invention comprise at least one nucleic acid molecule which encodes two surface-exposed GAS antigens. Still other compositions of the invention comprise at least two antibodies, each of which specifically binds to one of two surface-exposed GAS antigens. Preferred compositions of the invention comprise at least one of the surface-exposed GAS antigens is a GAS40 antigen and the other antigen is any other GAS antigen; at least one nucleic acid molecule encoding the two antigens, or at least two antibodies which specifically bind to the two antigens. Some compositions comprise one or more additional GAS antigens, a nucleic acid molecule encoding the additional antigen(s), or an antibody which specifically binds to the additional antigen(s); of these antigens, GAS117 is preferred.

As described above, some compositions of the invention comprise a nucleic acid molecule which encodes the at least two GAS antigens and, optionally, other antigens which can be included in the composition (see below). See, e.g., Robinson & Torres (1997) Seminars in Immunology 9:271-283; Donnelly et al. (1997) Ann. Rev Immunol 15:617-648; Scott-Taylor & Dalgleish (2000) Expert Opin Investig Drugs 9:471-480; Apostolopoulos & Plebanski (2000) Curr Opin Mol Ther 2:441-447; Ilan (1999) Curr Opin Mol Ther 1:116-120; Dubensky et al. (2000) Mol Med 6:723-732; Robinson & Pertmer (2000) Adv Virus Res 55:1-74; Donnelly et al. (2000) Am J Respir Crit. Care Med 162(4 Pt 2):S190-193; Davis (1999) Mt. Sinai J. Med. 66:84-90. Typically the nucleic acid molecule is a DNA molecule, e.g., in the form of a plasmid.

Compositions for treating S. pyogenes infections comprise at least one antibody which specifically binds to a GAS antigen and, optionally, an antibody which specifically binds to a non-GAS antigen. Some compositions of the invention are immunogenic and comprise one or more polypeptide antigens, while other immunogenic compositions comprise nucleic acid molecules which encode a surface-exposed and/or surface-associated GAS antigen and, optionally, a secondary GAS antigen or a non-GAS antigen. See, e.g., Robinson & Torres (1997) Seminars in Immunology 9:271-283; Donnelly et al. (1997) Ann. Rev Immunol 15:617-648; Scott-Taylor & Dalgleish (2000) Expert Opin Investig Drugs 9:471-480; Apostolopoulos & Plebanski (2000) Curr Opin Mol Ther 2:441-447; Ilan (1999) Curr Opin Mol Ther 1:116-120; Dubensky et al. (2000) Mol Med 6:723-732; Robinson & Pertmer (2000) Adv Virus Res 55:1-74; Donnelly et al. (2000) Am J Respir Crit. Care Med 162(4 Pt 2):S190-193Davis (1999) Mt. Sinai J. Med. 66:84-90. Typically the nucleic acid molecule is a DNA molecule, e.g., in the form of a plasmid.

Other compositions of the invention comprise at least one active agent. Compositions for preventing S. pyogenes infection can comprise as an active agent either a polypeptide comprising a GAS antigen of the invention or a nucleic acid molecule which encodes the polypeptide.

In some embodiments, compositions of the invention can include one or more additional active agents. Such agents include, but are not limited to, (a) another GAS antigen of the invention, preferably a surface-exposed antigen, (b) a polypeptide antigen which is useful in a pediatric vaccine, (c) a polypeptide antigen which is useful in a vaccine for elderly or immunocompromised individuals, (d) a nucleic acid molecule encoding (a)-(c), and an antibody which specifically binds to (a)-(c).

Additional Antigens

Compositions of the invention may be administered in conjunction with one or more antigens for use in therapeutic, prophylactic, or diagnostic methods of the present invention. Preferred antigens include those listed below. Additionally, the compositions of the present invention may be used to treat or prevent infections caused by any of the below-listed pathogens. In addition to combination with the antigens described below, the compositions of the invention may also be combined with an adjuvant as described herein.

Antigens for use with the invention include, but are not limited to, one or more of the following antigens set forth below, or antigens derived from one or more of the pathogens set forth below:

A. Bacterial Antigens

Bacterial antigens suitable for use in the invention include proteins, polysaccharides, lipopolysaccharides, and outer membrane vesicles which may be isolated, purified or derived from a bacteria. In addition, bacterial antigens may include bacterial lysates and inactivated bacteria formulations. Bacteria antigens may be produced by recombinant expression. Bacterial antigens preferably include epitopes which are exposed on the surface of the bacteria during at least one stage of its life cycle. Bacterial antigens are preferably conserved across multiple serotypes. Bacterial antigens include antigens derived from one or more of the bacteria set forth below as well as the specific antigens examples identified below.

*Neisseria meningitides*: Meningitides antigens may include proteins (such as those identified in References 1-7), saccharides (including a polysaccharide, oligosaccharide or lipopolysaccharide), or outer-membrane vesicles (References 8, 9, 10, 11) purified or derived from *N. meningitides* serogroup such as A, C, W135, Y, and/or B. *Meningitides* protein antigens may be selected from adhesions, autotransporters, toxins, Fe acquisition proteins, and membrane associated proteins (preferably integral outer membrane protein).

*Streptococcus pneumoniae*: *Streptococcus pneumoniae* antigens may include a saccharide (including a polysaccharide or an oligosaccharide) and/or protein from *Streptococcus pneumoniae*. Saccharide antigens may be selected from serotypes 1, 2, 3, 4, 5, 6B, 7F, 8, 9N, 9V, 10A, 11A, 12F, 14, 15B, 17F, 18C, 19A, 19F, 20, 22F, 23F, and 33F. Protein antigens may be selected from a protein identified in WO 98/18931, WO 98/18930, U.S. Pat. No. 6,699,703, U.S. Pat. No. 6,800,744, WO 97/43303, and WO 97/37026.

*Streptococcus pneumoniae* proteins may be selected from the Poly Histidine Triad family (PhtX), the Choline Binding Protein family (CbpX), CbpX truncates, LytX family, LytX truncates, CbpX truncate-LytX truncate chimeric proteins, pneumolysin (Ply), PspA, PsaA, Sp128, Sp101, Sp130, Sp125 or Sp133.

*Streptococcus pyogenes* (Group A *Streptococcus*): Group A *Streptococcus* antigens may include a protein identified in WO 02/34771 or WO 2005/032582 (including GAS 40), fusions of fragments of GAS M proteins (including those described in WO 02/094851, and Dale, Vaccine (1999) 17:193-200, and Dale, Vaccine 14(10): 944-948), fibronectin binding protein (Sfb1), Streptococcal heme-associated protein (Shp), and Streptolysin S (SagA).

*Moraxella catarrhalis*: *Moraxella* antigens include antigens identified in WO 02/18595 and WO 99/58562, outer membrane protein antigens (HMW-OMP), C-antigen, and/or LPS.

*Bordetella pertussis*: Pertussis antigens include petussis holotoxin (PT) and filamentous haemagglutinin (FHA) from *B. pertussis*, optionally also combination with pertactin and/or agglutinogens 2 and 3 antigen.

*Staphylococcus aureus*: *Staphylococcus aureus* antigens include *S. aureus* type 5 and 8 capsular polysaccharides optionally conjugated to nontoxic recombinant *Pseudomonas aeruginosa* exotoxin A, such as StaphVAX™, or antigens derived from surface proteins, invasins (leukocidin, kinases, hyaluronidase), surface factors that inhibit phagocytic engulfment (capsule, Protein A), carotenoids, catalase production, Protein A, coagulase, clotting factor, and/or membrane-damaging toxins (optionally detoxified) that lyse eukaryotic cell membranes (hemolysins, leukotoxin, leukocidin).

*Staphylococcus epidermis*: *S. epidermidis* antigens include slime-associated antigen (SAA).

*Clostridium tetani* (Tetanus): Tetanus antigens include tetanus toxoid (TT), preferably used as a carrier protein in conjunction/conjugated with the compositions of the present invention.

*Cornynebacterium diphtheriae* (Diphtheria): Diphtheria antigens include diphtheria toxin, preferably detoxified, such as CRM197. Additionally antigens capable of modulating, inhibiting or associated with ADP ribosylation are contemplated for combination/co-administration/conjugation with the compositions of the present invention. The diphtheria toxoids may be used as carrier proteins.

*Haemophilus influenzae* B (Hib): Hib antigens include a Hib saccharide antigen.

*Pseudomonas aeruginosa*: *Pseudomonas* antigens include endotoxin A, Wzz protein, *P. aeruginosa* LPS, more particularly LPS isolated from PAO1 (O5 serotype), and/or Outer Membrane Proteins, including Outer Membrane Proteins F (OprF) (Infect Immun. 2001 May; 69(5): 3510-3515).

*Legionella pneumophila*. Bacterial antigens may be derived from *Legionella pneumophila*.

*Streptococcus agalactiae* (Group B *Streptococcus*): Group B *Streptococcus* antigens include a protein or saccharide antigen identified in WO 02/34771, WO 03/093306, WO 04/041157, or WO 2005/002619 (including proteins GBS 80, GBS 104, GBS 276 and GBS 322, and including saccharide antigens derived from serotypes Ia, Ib, Ia/c, II, III, IV, V, VI, VII and VIII).

*Neiserria gonorrhoeae*: Gonorrhoeae antigens include Por (or porin) protein, such as PorB (see Zhu et al., Vaccine (2004) 22:660-669), a transferring binding protein, such as TbpA and TbpB (See Price et al., Infection and Immunity (2004) 71(1):277-283), a opacity protein (such as Opa), a reduction-modifiable protein (Rmp), and outer membrane vesicle (OMV) preparations (see Plante et al., J Infectious Disease (2000) 182:848-855), also see e.g. WO99/24578, WO99/36544, WO99/57280, WO02/079243).

*Chlamydia trachomatis*: *Chlamydia trachomatis* antigens include antigens derived from serotypes A, B, Ba and C (agents of trachoma, a cause of blindness), serotypes L1, L2 & L3 (associated with *Lymphogranuloma venereum*), and serotypes, D-K. *Chlamydia* trachomas antigens may also include an antigen identified in WO 00/37494, WO 03/049762, WO 03/068811, or WO 05/002619, including PepA (CT045), LcrE (CT089), ArtJ (CT381), DnaK (CT396), CT398, OmpH-like (CT242), L7/L12 (CT316), OmcA (CT444), AtosS (CT467), CT547, Eno (CT587), HrtA (CT823), and MurG (CT761).

*Treponema pallidum* (Syphilis): Syphilis antigens include TmpA antigen.

*Haemophilus ducreyi* (causing chancroid): *Ducreyi* antigens include outer membrane protein (DsrA).

*Enterococcus faecalis* or *Enterococcus faecium*: Antigens include a trisaccharide repeat or other *Enterococcus* derived antigens provided in U.S. Pat. No. 6,756,361.

*Helicobacter pylori*: *H. pylori* antigens include Cag, Vac, Nap, HopX, HopY and/or urease antigen.

*Staphylococcus saprophyticus*: Antigens include the 160 kDa hemagglutinin of *S. saprophyticus* antigen.

*Yersinia enterocolitica* antigens include LPS (Infect Immun. 2002 August; 70(8): 4414).

*E. coli*: *E. coli* antigens may be derived from enterotoxigenic *E. coli* (ETEC), enteroaggregative *E. coli* (EAggEC), diffusely adhering *E. coli* (DAEC), enteropathogenic *E. coli* (EPEC), and/or enterohemorrhagic *E. coli* (EHEC).

*Bacillus anthracis* (anthrax): *B. anthracis* antigens are optionally detoxified and may be selected from A-components (lethal factor (LF) and edema factor (EF)), both of which can share a common B-component known as protective antigen (PA).

*Yersinia pestis* (plague): Plague antigens include F1 capsular antigen (Infect Immun. 2003 January; 71(1)): 374-383, LPS (Infect Immun. 1999 October; 67(10): 5395), *Yersinia pestis* V antigen (Infect Immun. 1997 November; 65(11): 4476-4482).

*Mycobacterium tuberculosis*: Tuberculosis antigens include lipoproteins, LPS, BCG antigens, a fusion protein of antigen 85B (Ag85B) and/or ESAT-6 optionally formulated in cationic lipid vesicles (Infect Immun. 2004 October; 72(10): 6148), *Mycobacterium tuberculosis* (Mtb) isocitrate dehydrogenase associated antigens (Proc Natl Acad Sci USA. 2004 Aug. 24; 101(34): 12652), and/or MPT51 antigens (Infect Immun. 2004 July; 72(7): 3829).

*Rickettsia*: Antigens include outer membrane proteins, including the outer membrane protein A and/or B (OmpB) (Biochim Biophys Acta. 2004 Nov. 1; 1702(2):145), LPS, and surface protein antigen (SPA) (J. Autoimmun. 1989 June; 2 Suppl:81).

*Listeria monocytogenes*. Bacterial antigens may be derived from *Listeria monocytogenes*.

*Chlamydia pneumoniae*: Antigens include those identified in WO 02/02606.

*Vibrio cholerae*: Antigens include proteinase antigens, LPS, particularly lipopolysaccharides of *Vibrio cholerae* II, O1 Inaba O-specific polysaccharides, *V. cholera* 0139, antigens of IEM108 vaccine (Infect Immun. 2003 October; 71(10):5498-504), and/or Zonula occludens toxin (Zot).

*Salmonella typhi* (typhoid fever): Antigens include capsular polysaccharides preferably conjugates (Vi, i.e. vax-TyVi).

*Borrelia burgdorferi* (Lyme disease): Antigens include lipoproteins (such as OspA, OspB, Osp C and Osp D), other surface proteins such as OspE-related proteins (Erps), decorin-binding proteins (such as DbpA), and antigenically variable VI proteins., such as antigens associated with P39 and P13 (an integral membrane protein, Infect Immun. 2001 May; 69(5): 3323-3334), VlsE Antigenic Variation Protein (J Clin Microbiol. 1999 December; 37(12): 3997).

*Porphyromonas gingivalis*: Antigens include *P. gingivalis* outer membrane protein (OMP).

*Klebsiella*: Antigens include an OMP, including OMP A, or a polysaccharide optionally conjugated to tetanus toxoid.

Further bacterial antigens of the invention may be capsular antigens, polysaccharide antigens or protein antigens of any of the above. Further bacterial antigens may also include an outer membrane vesicle (OMV) preparation. Additionally, antigens include live, attenuated, and/or purified versions of any of the aforementioned bacteria. The antigens of the present invention may be derived from gram-negative or gram-positive bacteria. The antigens of the present invention may be derived from aerobic or anaerobic bacteria.

Additionally, any of the above bacterial-derived saccharides (polysaccharides, LPS, LOS or oligosaccharides) can be conjugated to another agent or antigen, such as a carrier protein (for example CRM197). Such conjugation may be direct conjugation effected by reductive amination of carbonyl moieties on the saccharide to amino groups on the protein, as provided in U.S. Pat. No. 5,360,897 and Can J Biochem Cell Biol. 1984 May; 62(5):270-5. Alternatively, the saccharides can be conjugated through a linker, such as, with succinamide or other linkages provided in Bioconjugate Techniques, 1996 and CRC, Chemistry of Protein Conjugation and Cross-Linking, 1993.

B. Viral Antigens

Viral antigens suitable for use in the invention include inactivated (or killed) virus, attenuated virus, split virus formulations, purified subunit formulations, viral proteins which may be isolated, purified or derived from a virus, and Virus Like Particles (VLPs). Viral antigens may be derived from viruses propagated on cell culture or other substrate. Alternatively, viral antigens may be expressed recombinantly. Viral antigens preferably include epitopes which are exposed on the surface of the virus during at least one stage of its life cycle. Viral antigens are preferably conserved across multiple serotypes or isolates. Viral antigens include antigens derived from one or more of the viruses set forth below as well as the specific antigens examples identified below.

*Orthomyxovirus*: Viral antigens may be derived from an *Orthomyxovirus*, such as Influenza A, B and C. *Orthomyxovirus* antigens may be selected from one or more of the viral proteins, including hemagglutinin (HA), neuraminidase (NA), nucleoprotein (NP), matrix protein (M1), membrane protein (M2), one or more of the transcriptase components (PB1, PB2 and PA). Preferred antigens include HA and NA.

Influenza antigens may be derived from interpandemic (annual) flu strains. Alternatively influenza antigens may be derived from strains with the potential to cause pandemic a pandemic outbreak (i.e., influenza strains with new haemagglutinin compared to the haemagglutinin in currently circulating strains, or influenza strains which are pathogenic in avian subjects and have the potential to be transmitted horizontally in the human population, or influenza strains which are pathogenic to humans).

Paramyxoviridae viruses: Viral antigens may be derived from Paramyxoviridae viruses, such as Pneumoviruses (RSV), Paramyxoviruses (PIV) and Morbilliviruses (Measles).

Pneumovirus: Viral antigens may be derived from a Pneumovirus, such as Respiratory syncytial virus (RSV), Bovine respiratory syncytial virus, Pneumonia virus of mice, and Turkey rhinotracheitis virus. Preferably, the Pneumovirus is RSV. Pneumovirus antigens may be selected from one or more of the following proteins, including surface proteins Fusion (F), Glycoprotein (G) and Small Hydrophobic protein (SH), matrix proteins M and M2, nucleocapsid proteins N, P and L and nonstructural proteins NS1 and NS2. Preferred Pneumovirus antigens include F, G and M. See e.g., J Gen Virol. 2004 November; 85(Pt 11):3229). Pneumovirus antigens may also be formulated in or derived from chimeric viruses. For example, chimeric RSV/PIV viruses may comprise components of both RSV and PIV.

Paramyxovirus: Viral antigens may be derived from a Paramyxovirus, such as Parainfluenza virus types 1-4 (PIV), Mumps, Sendai viruses, Simian virus 5, Bovine parainfluenza virus and Newcastle disease virus. Preferably, the Paramyxovirus is PIV or Mumps. Paramyxovirus antigens may be selected from one or more of the following proteins: Hemagglutinin-Neuraminidase (HN), Fusion proteins F1 and F2, Nucleoprotein (NP), Phosphoprotein (P), Large protein (L), and Matrix protein (M). Preferred Paramyxovirus proteins include HN, F1 and F2. Paramyxovirus antigens may also be formulated in or derived from chimeric viruses. For example, chimeric RSV/PIV viruses may comprise components of both RSV and PIV. Commercially available mumps vaccines include live attenuated mumps virus, in either a monovalent form or in combination with measles and rubella vaccines (MMR).

Morbillivirus: Viral antigens may be derived from a Morbillivirus, such as Measles. Morbillivirus antigens may be selected from one or more of the following proteins: hemagglutinin (H), Glycoprotein (G), Fusion factor (F), Large protein (L), Nucleoprotein (NP), Polymerase phosphoprotein (P), and Matrix (M). Commercially available measles vaccines include live attenuated measles virus, typically in combination with mumps and rubella (MMR).

Picornavirus: Viral antigens may be derived from Picornaviruses, such as Enteroviruses, Rhinoviruses, Hepamavirus, Cardioviruses and Aphthoviruses. Antigens derived from *Enteroviruses*, such as Poliovirus are preferred.

Enterovirus: Viral antigens may be derived from an Enterovirus, such as Poliovirus types 1, 2 or 3, Coxsackie A virus types 1 to 22 and 24, Coxsackie B virus types 1 to 6, Echovirus (ECHO) virus) types 1 to 9, 11 to 27 and 29 to 34 and Enterovirus 68 to 71. Preferably, the Enterovirus is poliovirus. Enterovirus antigens are preferably selected from one or more of the following Capsid proteins VP1, VP2, VP3 and VP4. Commercially available polio vaccines include Inactivated Polio Vaccine (IPV) and Oral poliovirus vaccine (OPV).

Heparnavirus: Viral antigens may be derived from an Heparnavirus, such as Hepatitis A virus (HAV). Commercially available HAV vaccines include inactivated HAV vaccine.

Togavirus: Viral antigens may be derived from a Togavirus, such as a Rubivirus, an *Alphavirus*, or an Arterivirus. Antigens derived from Rubivirus, such as Rubella virus, are preferred. Togavirus antigens may be selected from E1, E2, E3, C, NSP-1, NSPO-2, NSP-3 or NSP-4. Togavirus antigens are preferably selected from E1, E2 or E3. Commercially available Rubella vaccines include a live cold-adapted virus, typically in combination with mumps and measles vaccines (MMR).

Flavivirus: Viral antigens may be derived from a Flavivirus, such as Tick-borne encephalitis (TBE), Dengue (types 1, 2, 3 or 4), Yellow Fever, Japanese encephalitis, West Nile encephalitis, St. Louis encephalitis, Russian spring-summer encephalitis, Powassan encephalitis. Flavivirus antigens may be selected from PrM, M, C, E, NS-1, NS-2a, NS2b, NS3, NS4a, NS4b, and NS5. Flavivirus antigens are preferably selected from PrM, M and E. Commercially available TBE vaccine include inactivated virus vaccines.

Pestivirus: Viral antigens may be derived from a Pestivirus, such as Bovine viral diarrhea (BVDV), Classical swine fever (CSFV) or Border disease (BDV).

Hepadnavirus: Viral antigens may be derived from a Hepadnavirus, such as Hepatitis B virus. Hepadnavirus antigens may be selected from surface antigens (L, M and S), core antigens (HBc, HBe). Commercially available HBV vaccines include subunit vaccines comprising the surface antigen S protein.

Hepatitis C virus: Viral antigens may be derived from a Hepatitis C virus (HCV). HCV antigens may be selected from one or more of E1, E2, E1/E2, NS345 polyprotein, NS 345-core polyprotein, core, and/or peptides from the nonstructural regions (Houghton et al., Hepatology (1991) 14:381).

Rhabdovirus: Viral antigens may be derived from a *Rhabdovirus*, such as a Lyssavirus (Rabies virus) and Vesiculovirus (VSV). Rhabdovirus antigens may be selected from glycoprotein (G), nucleoprotein (N), large protein (L), nonstructural proteins (NS). Commercially available Rabies virus vaccine comprise killed virus grown on human diploid cells or fetal rhesus lung cells.

Caliciviridae; Viral antigens may be derived from Calciviridae, such as Norwalk virus, and Norwalk-like Viruses, such as Hawaii Virus and Snow Mountain Virus.

Coronavirus: Viral antigens may be derived from a Coronavirus, SARS, Human respiratory coronavirus, Avian infectious bronchitis (IBV), Mouse hepatitis virus (MHV), and Porcine transmissible gastroenteritis virus (TGEV). Coronavirus antigens may be selected from spike (S), envelope (E), matrix (M), nucleocapsid (N), and Hemagglutinin-esterase glycoprotein (HE). Preferably, the Coronavirus antigen is derived from a SARS virus. SARS viral antigens are described in WO 04/92360;

Retrovirus: Viral antigens may be derived from a Retrovirus, such as an Oncovirus, a Lentivirus or a Spumavirus. Oncovirus antigens may be derived from HTLV-1, HTLV-2 or HTLV-5. Lentivirus antigens may be derived from HIV-1 or HIV-2. Retrovirus antigens may be selected from gag, pol, env, tax, tat, rex, rev, nef, vif, vpu, and vpr. HIV antigens may be selected from gag (p24gag and p55gag), env (gp160 and gp41), pol, tat, nef, rev vpu, miniproteins, (preferably p55 gag and gp140v delete). HIV antigens may be derived from one or more of the following strains: HIVIIIb, HIVSF2, HIVLAV, HIVLAI, HIVMN, HIV-1CM235, HIV-1US4.

Reovirus: Viral antigens may be derived from a Reovirus, such as an Orthoreovirus, a Rotavirus, an Orbivirus, or a Coltivirus. Reovirus antigens may be selected from structural proteins λ1, λ2, λ3, μ1, μ2, σ1, σ2, or σ3, or nonstructural proteins σNS, μNS, or σls. Preferred Reovirus antigens may be derived from a Rotavirus. Rotavirus antigens may be selected from VP1, VP2, VP3, VP4 (or the cleaved product VP5 and VP8), NSP 1, VP6, NSP3, NSP2, VP7, NSP4, or NSP5. Preferred Rotavirus antigens include VP4 (or the cleaved product VP5 and VP8), and VP7.

Parvovirus: Viral antigens may be derived from a Parvovirus, such as Parvovirus B19. Parvovirus antigens may be selected from VP-1, VP-2, VP-3, NS-1 and NS-2. Preferably, the Parvovirus antigen is capsid protein VP-2.

Delta hepatitis virus (HDV): Viral antigens may be derived HDV, particularly δ-antigen from HDV (see, e.g., U.S. Pat. No. 5,378,814).

Hepatitis E virus (HEV): Viral antigens may be derived from HEV.

Hepatitis G virus (HGV): Viral antigens may be derived from HGV.

Human Herpesvirus Viral antigens may be derived from a Human Herpesvirus, such as Herpes Simplex Viruses (HSV), Varicella-zoster virus (VZV), Epstein-Barr virus (EBV), Cytomegalovirus (CMV), Human Herpesvirus 6 (HHV6), Human Herpesvirus 7 (HHV7), and Human Herpesvirus 8 (HHV8). Human Herpesvirus antigens may be selected from immediate early proteins (α), early proteins (β), and late proteins (γ). HSV antigens may be derived from HSV-1 or HSV-2 strains. HSV antigens may be selected from glycoproteins gB, gC, gD and gH, fusion protein (gB), or immune escape proteins (gC, gE, or gI). VZV antigens may be selected from core, nucleocapsid, tegument, or envelope proteins. A live attenuated VZV vaccine is commercially available. EBV antigens may be selected from early antigen (EA) proteins, viral capsid antigen (VCA), and glycoproteins of the membrane antigen (MA). CMV antigens may be selected from capsid proteins, envelope glycoproteins (such as gB and gH), and tegument proteins Papovaviruses: Antigens may be derived from Papovaviruses, such as Papillomaviruses and Polyomaviruses. Papillomaviruses include HPV serotypes 1, 2, 4, 5, 6, 8, 11, 13, 16, 18, 31, 33, 35, 39, 41, 42, 47, 51, 57, 58, 63 and 65. Preferably, HPV antigens are derived from serotypes 6, 11, 16 or 18. HPV antigens may be selected from capsid proteins (L1) and (L2), or E1-E7, or fusions thereof. HPV antigens are preferably formulated into virus-like particles (VLPs). Polyomyavirus viruses include BK virus and JK virus. Polyomavirus antigens may be selected from VP1, VP2 or VP3.

Further provided are antigens, compositions, methods, and microbes included in Vaccines, 4th Edition (Plotkin and Orenstein ed. 2004); Medical Microbiology 4th Edition (Murray et al. ed. 2002); Virology, 3rd Edition (W. K. Joklik ed. 1988); Fundamental Virology, 2nd Edition (B. N. Fields and D. M. Knipe, eds. 1991), which are contemplated in conjunction with the compositions of the present invention.

C. Fungal Antigens

Fungal antigens for use in the invention may be derived from one or more of the fungi set forth below.

Fungal antigens may be derived from Dermatophytres, including: *Epidermophyton floccusum, Microsporum audouini, Microsporum canis, Microsporum distortum, Microsporum equinum, Microsporum gypsum, Microsporum nanum, Trichophyton concentricum, Trichophyton equinum, Trichophyton gallinae, Trichophyton gypseum, Trichophyton megnini, Trichophyton mentagrophytes, Trichophyton quinckeanum, Trichophyton rubrum, Trichophyton schoenleini, Trichophyton tonsurans, Trichophyton verrucosum, T. verrucosum* var. *album*, var. *discoides*, var. *ochraceum*, *Trichophyton violaceum*, and/or *Trichophyton faviforme*.

Fungal pathogens may be derived from *Aspergillus fumigatus, Aspergillus flavus, Aspergillus niger, Aspergillus nidulans, Aspergillus terreus, Aspergillus sydowi, Aspergillus flavatus, Aspergillus glaucus, Blastoschizomyces capitatus, Candida albicans, Candida enolase, Candida tropicalis, Candida glabrata, Candida krusei, Candida parapsilosis, Candida stellatoidea, Candida kusei, Candida parakwsei, Candida lusitaniae, Candida pseudotropicalis, Candida guilliermondi, Cladosporium carrionii, Coccidioides immitis, Blastomyces dermatidis, Cryptococcus neoformans, Geotrichum clavatum, Histoplasma capsulatum, Klebsiella pneumoniae, Paracoccidioides brasiliensis, Pneumocystis carinii, Pythiunm insidiosum, Pityrosporum ovale, Sacharomyces cerevisae, Saccharomyces boulardii, Saccharomyces pombe, Scedosporium apiosperum, Sporothrix schenckii, Trichosporon beigelii, Toxoplasma gondii, Penicillium marneffei, Malassezia* spp., *Fonsecaea* spp., *Wangiella* spp., *Sporothrix* spp., *Basidiobolus* spp., *Conidiobolus* spp., *Rhizopus* spp, *Mucor* spp, *Absidia* spp, *Mortierella* spp, *Cunninghamella* spp, *Saksenaea* spp., *Alternaria* spp, *Curvularia* spp, *Helminthosporium* spp, *Fusarium* spp, *Aspergillus* spp, *Penicillium* spp, *Monolinia* spp, *Rhizoctonia* spp, *Paecilomyces* spp, *Pithomyces* spp, and *Cladosporium* spp.

Processes for producing a fungal antigens are well known in the art (see U.S. Pat. No. 6,333,164). In a preferred method a solubilized fraction extracted and separated from an insoluble fraction obtainable from fungal cells of which cell wall has been substantially removed or at least partially removed, characterized in that the process comprises the steps of: obtaining living fungal cells; obtaining fungal cells of which cell wall has been substantially removed or at least partially removed; bursting the fungal cells of which cell wall has been substantially removed or at least partially removed; obtaining an insoluble fraction; and extracting and separating a solubilized fraction from the insoluble fraction.

D. STD Antigens

The compositions of the invention may include one or more antigens derived from a sexually transmitted disease (STD). Such antigens may provide for prophylactis or therapy for STD's such as chlamydia, genital herpes, hepatits (such as HCV), genital warts, gonorrhoea, syphilis and/or chancroid (See, WO00/15255). Antigens may be derived from one or more viral or bacterial STD's. Viral STD antigens for use in the invention may be derived from, for example, HIV, herpes simplex virus (HSV-1 and HSV-2), human papillomavirus (HPV), and hepatitis (HCV). Bacterial STD antigens for use in the invention may be derived from, for example, *Neiserria gonorrhoeae, Chlamydia trachomatis, Treponema pallidum, Haemophilus ducreyi, E. coli*, and *Streptococcus agalactiae*. Examples of specific antigens derived from these pathogens are described above.

E. Respiratory Antigens

The compositions of the invention may include one or more antigens derived from a pathogen which causes respiratory disease. For example, respiratory antigens may be derived from a respiratory virus such as Orthomyxoviruses (influenza), Pneumovirus (RSV), Paramyxovirus (PIV), Morbillivirus (measles), Togavirus (Rubella), VZV, and Coronavirus (SARS). Respiratory antigens may be derived from a bacteria which causes respiratory disease, such as *Streptococcus pneumoniae, Pseudomonas aeruginosa, Bordetella pertussis, Mycobacterium tuberculosis, Mycoplasma pneumoniae, Chlamydia pneumoniae, Bacillus anthracis*, and *Moraxella catarrhalis*. Examples of specific antigens derived from these pathogens are described above.

F. Pediatric Vaccine Antigens

The compositions of the invention may include one or more antigens suitable for use in pediatric subjects. Pediatric subjects are typically less than about 3-years old, or less than about 2 years old, or less than about 1 years old. Pediatric antigens may be administered multiple times over the course of 6 months, 1, 2 or 3 years. Pediatric antigens may be derived from a virus which may target pediatric populations and/or a virus from which pediatric populations are susceptible to infection. Pediatric viral antigens include antigens derived from one or more of Orthomyxovirus (influenza), Pneumovirus (RSV), Paramyxovirus (PIV and Mumps), Morbillivirus (measles), Togavirus (Rubella), Enterovirus (polio), HBV, Coronavirus (SARS), and Varicella-zoster virus (VZV), Epstein Barr virus (EBV). Pediatric bacterial antigens include antigens derived from one or more of *Streptococcus pneumoniae, Neisseria meningitides, Streptococcus pyogenes* (Group A *Streptococcus*), *Moraxella catarrhalis, Bordetella pertussis, Staphylococcus aureus, Clostridium tetani* (Tetanus), *Corynebacterium diphtheriae* (Diphtheria), *Haemophilus influenzae* B (Hib), *Pseudomonas aeruginosa, Streptococcus agalactiae* (Group B *Streptococcus*), and *E. coli*. Examples of specific antigens derived from these pathogens are described above.

G. Antigens Suitable for Use in Elderly or Immunocompromised Individuals

The compositions of the invention may include one or more antigens suitable for use in elderly or immunocompromised individuals. Such individuals may need to be vaccinated more frequently, with higher doses or with adjuvanted formulations to improve their immune response to the targeted antigens. Antigens which may be targeted for use in Elderly or Immunocompromised individuals include antigens derived from one or more of the following pathogens: *Neisseria meningitides, Streptococcus pneumoniae, Streptococcus pyogenes* (Group A *Streptococcus*), *Moraxella catarrhalis, Bordetella pertussis, Staphylococcus aureus, Staphylococcus epidermis, Clostridium tetani* (Tetanus), *Corynebacterium diphtheriae* (Diphtheria), *Haemophilus influenzae* B (Hib), *Pseudomonas aeruginosa, Legionella pneumophila, Streptococcus agalactiae* (Group B *Streptococcus*), *Enterococcus faecalis, Helicobacter pylori, Clamydia pneumoniae, Orthomyxovirus* (influenza), Pneumovirus (RSV), *Paramyxovirus* (PIV and Mumps), *Morbillivirus* (measles), *Togavirus* (Rubella), *Enterovirus* (polio), HBV, *Coronavirus* (SARS), Varicella-zoster virus (VZV), Epstein Barr virus (EBV), *Cytomegalovirus* (CMV). Examples of specific antigens derived from these pathogens are described above.

H. Antigens Suitable for Use in Adolescent Vaccines

The compositions of the invention may include one or more antigens suitable for use in adolescent subjects. Adolescents may be in need of a boost of a previously administered pediatric antigen. Pediatric antigens which may be suitable for use in adolescents are described above. In addition, adolescents may be targeted to receive antigens derived from an STD pathogen in order to ensure protective or therapeutic immunity before the beginning of sexual activity. STD antigens which may be suitable for use in adolescents are described above.

I. Antigen Formulations

In other aspects of the invention, methods of producing microparticles having adsorbed antigens are provided. The methods comprise: (a) providing an emulsion by dispersing a mixture comprising (i) water, (ii) a detergent, (iii) an organic solvent, and (iv) a biodegradable polymer selected from the group consisting of a poly(α-hydroxy acid), a polyhydroxy butyric acid, a polycaprolactone, a polyorthoester, a polyanhydride, and a polycyanoacrylate. The polymer is typically present in the mixture at a concentration of about 1% to about 30% relative to the organic solvent, while the detergent is typically present in the mixture at a weight-to-weight detergent-to-polymer ratio of from about 0.00001:1 to about 0.1:1 (more typically about 0.0001:1 to about 0.1:1, about 0.001:1 to about 0.1:1, or about 0.005:1 to about 0.1:1); (b) removing the organic solvent from the emulsion; and (c) adsorbing an antigen on the surface of the microparticles. In certain embodiments, the biodegradable polymer is present at a concentration of about 3% to about 10% relative to the organic solvent.

Microparticles for use herein will be formed from materials that are sterilizable, non-toxic and biodegradable. Such materials include, without limitation, poly(α-hydroxy acid), polyhydroxybutyric acid, polycaprolactone, polyorthoester, polyanhydride, PACA, and polycyanoacrylate. Preferably, microparticles for use with the present invention are derived from a poly(α-hydroxy acid), in particular, from a poly(lactide) ("PLA") or a copolymer of D,L-lactide and glycolide or glycolic acid, such as a poly(D,L-lactide-co-glycolide) ("PLG" or "PLGA"), or a copolymer of D,L-lactide and caprolactone. The microparticles may be derived from any of various polymeric starting materials which have a variety of molecular weights and, in the case of the copolymers such as PLG, a variety of lactide:glycolide ratios, the selection of which will be largely a matter of choice, depending in part on the coadministered macromolecule. These parameters are discussed more fully below.

Further antigens may also include an outer membrane vesicle (OMV) preparation. Additional formulation methods and antigens (especially tumor antigens) are provided in U.S. patent Ser. No. 09/581,772.

J. Antigen References

The following references include antigens useful in conjunction with the compositions of the present invention:

1  International patent application WO99/24578
2  International patent application WO99/36544.
3  International patent application WO99/57280.
4  International patent application WO00/22430.
5  Tettelin et al. (2000) Science 287:1809-1815.
6  International patent application WO96/29412.
7  Pizza et al. (2000) Science 287:1816-1820.
8  PCT WO 01/52885.
9  Bjune et al. (1991) Lancet 338(8775).
10 Fuskasawa et al. (1999) Vaccine 17:2951-2958.
11 Rosenqist et al. (1998) Dev. Biol. Strand 92:323-333.
12 Constantino et al. (1992) Vaccine 10:691-698.
13 Constantino et al. (1999) Vaccine 17:1251-1263.
14 Watson (2000) Pediatr Infect Dis J 19:331-332.
15 Rubin (20000) Pediatr Clin North Am 47:269-285,v.
16 Jedrzejas (2001) Microbiol Mol Biol Rev 65:187-207.
17 International patent application filed on 3rd July 2001 claiming priority from GB-0016363.4;WO 02/02606; PCT IB/01/00166.
18 Kalman et al. (1999) Nature Genetics 21:385-389.
19 Read et al. (2000) Nucleic Acids Res 28:1397-406.
20 Shirai et al. (2000) J. Infect. Dis 181(Suppl 3):S524-S527.
21 International patent application WO99/27105.
22 International patent application WO00/27994.
23 International patent application WO00/37494.
24 International patent application WO99/28475.
25 Bell (2000) Pediatr Infect Dis J 19:1187-1188.
26 Iwarson (1995) APMIS 103:321-326.
27 Gerlich et al. (1990) Vaccine 8 Suppl:S63-68 & 79-80.
28 Hsu et al. (1999) Clin Liver Dis 3:901-915.
29 Gastofsson et al. (1996) N. Engl. J. Med. 334-:349-355.
30 Rappuoli et al. (1991) TIBTECH 9:232-238.
31 Vaccines (1988) eds. Plotkin & Mortimer. ISBN 0-7216-1946-0.
32 Del Guidice et al. (1998) Molecular Aspects of Medicine 19:1-70.
33 International patent application WO93/018150.
34 International patent application WO99/53310.
35 International patent application WO98/04702.
36 Ross et al. (2001) Vaccine 19:135-142.
37 Sutter et al. (2000) Pediatr Clin North Am 47:287-308.
38 Zimmerman & Spann (1999) Am Fan Physician 59:113-118, 125-126.
39 Dreensen (1997) Vaccine 15 Suppl"S2-6.
40 MMWR Morb Mortal Wkly rep 1998 Jan 16:47(1):12, 9.
41 McMichael (2000) Vaccine19 Suppl 1:S101-107.
42 Schuchat (1999) Lancer 353(9146):51-6.
43 GB patent applications 0026333.5, 0028727.6 & 0105640.7.
44 Dale (1999) Infect Disclin North Am 13:227-43, viii.
45 Ferretti et al. (2001) PNAS USA 98: 4658-4663.
46 Kuroda et al. (2001) Lancet 357(9264):1225-1240; see also pages 1218-1219.
47 Ramsay et al. (2001) Lancet 357(9251):195-196.
48 Lindberg (1999) Vaccine 17 Suppl 2:S28-36.
49 Buttery & Moxon (2000) J R Coil Physicians Long 34:163-168.
50 Ahmad & Chapnick (1999) Infect Dis Clin North Am 13:113-133, vii.
51 Goldblatt (1998) J. Med. Microbiol. 47:663-567.
52 European patent 0 477 508.
53 U.S. Pat. No. 5,306,492.
54 International patent application WO98/42721.
55 Conjugate Vaccines (eds. Cruse et al.) ISBN 3805549326, particularly vol. 10:48-114.
56 Hermanson (1996) Bioconjugate Techniques ISBN: 012323368 & 012342335X.
57 European patent application 0372501.
58 European patent application 0378881.
59 European patent application 0427347.
60 International patent application WO93/17712.
61 International patent application WO98/58668.
62 European patent application 0471177.
63 International patent application WO00/56360.
64 International patent application WO00/67161.

The contents of all of the above cited patents, patent applications and journal articles are incorporated by reference as if set forth fully herein.

Where a saccharide or carbohydrate antigen is used, it is preferably conjugated to a carrier protein in order to enhance immunogenicity. See Ramsay et al (2001) Lancet 357(9251): 195-196; Lindberg (1999) Vaccine 17 Suppl 2:S28-36; Buttery & Moxon (2000) J R Coll Physicians Lond 34:163-168; Ahmad & Chapnick (1999) Infect Dis Clin North Am 13:113-133, vii; Goldblatt (1998) J. Med. Microbiol. 47:563-567; European patent 0 477 508; U.S. Pat. No. 5,306,492; WO98/

42721; Conjugate Vaccines (eds. Cruse et al.) ISBN 3805549326, particularly vol. 10:48-114; Hermanson (1996) Bioconjugate Techniques ISBN: 0123423368 or 012342335X. Preferred carrier proteins are bacterial toxins or toxoids, such as diphtheria or tetanus toxoids. The CRM197 diphtheria toxoid is particularly preferred.

Other carrier polypeptides include the *N. meningitidis* outer membrane protein (EP-A-0372501), synthetic peptides (EP-A-0378881 and EP-A 0427347), heat shock proteins (WO 93/17712 and WO 94/03208), pertussis proteins (WO 98/58668 and EP A 0471177), protein D from *H. influenzae* (WO 00/56360), cytokines (WO 91/01146), lymphokines, hormones, growth factors, toxin A or B from *C. difficile* (WO 00/61761), iron-uptake proteins (WO 01/72337), etc. Where a mixture comprises capsular saccharide from both serigraphs A and C, it may be preferred that the ratio (w/w) of MenA saccharide:MenC saccharide is greater than 1 (e.g., 2:1, 3:1, 4:1, 5:1, 10:1 or higher). Different saccharides can be conjugated to the same or different type of carrier protein. Any suitable conjugation reaction can be used, with any suitable linker where necessary.

Toxic protein antigens may be detoxified where necessary e.g., detoxification of pertussis toxin by chemical and/or genetic means.

Pharmaceutically Acceptable Carriers

Compositions of the invention will typically, in addition to the components mentioned above, comprise one or more "pharmaceutically acceptable carriers." These include any carrier which does not itself induce the production of antibodies harmful to the individual receiving the composition. Suitable carriers typically are large, slowly metabolized macromolecules such as proteins, polysaccharides, polylactic acids, polyglycolic acids, polymeric amino acids, amino acid copolymers, and lipid aggregates (such as oil droplets or liposomes). Such carriers are well known to those of ordinary skill in the art. A composition may also contain a diluent, such as water, saline, glycerol, etc. Additionally, an auxiliary substance, such as a wetting or emulsifying agent, pH buffering substance, and the like, may be present. A thorough discussion of pharmaceutically acceptable components is available in Gennaro (2000) Remington: The Science and Practice of Pharmacy. 20th ed., ISBN: 0683306472.

Immunoregulatory Agents

Adjuvants

Vaccines of the invention may be administered in conjunction with other immunoregulatory agents. In particular, compositions will usually include an adjuvant. Adjuvants for use with the invention include, but are not limited to, one or more of the following set forth below:

A. Mineral Containing Compositions

Mineral containing compositions suitable for use as adjuvants in the invention include mineral salts, such as aluminum salts and calcium salts. The invention includes mineral salts such as hydroxides (e.g. oxyhydroxides), phosphates (e.g. hydroxyphosphates, orthophosphates), sulfates, etc. (e.g. see chapters 8 & 9 of Vaccine Design . . . (1995) eds. Powell & Newman. ISBN: 030644867X. Plenum.), or mixtures of different mineral compounds (e.g. a mixture of a phosphate and a hydroxide adjuvant, optionally with an excess of the phosphate), with the compounds taking any suitable form (e.g. gel, crystalline, amorphous, etc.), and with adsorption to the salt(s) being preferred. The mineral containing compositions may also be formulated as a particle of metal salt (WO00/23105).

Aluminum salts may be included in vaccines of the invention such that the dose of $Al_{3+}$ is between 0.2 and 1.0 mg per dose.

In one embodiment the aluminum based adjuvant for use in the present invention is alum (aluminum potassium sulfate ($AlK(SO_4)_2$)), or an alum derivative, such as that formed in-situ by mixing an antigen in phosphate buffer with alum, followed by titration and precipitation with a base such as ammonium hydroxide or sodium hydroxide.

Another aluminum-based adjuvant for use in vaccine formulations of the present invention is aluminum hydroxide adjuvant ($Al(OH)_3$) or crystalline aluminum oxyhydroxide (AlOOH), which is an excellent adsorbant, having a surface area of approximately 500 $m_2/g$. Alternatively, aluminum phosphate adjuvant ($AlPO_4$) or aluminum hydroxyphosphate, which contains phosphate groups in place of some or all of the hydroxyl groups of aluminum hydroxide adjuvant is provided. Preferred aluminum phosphate adjuvants provided herein are amorphous and soluble in acidic, basic and neutral media.

In another embodiment the adjuvant of the invention comprises both aluminum phosphate and aluminum hydroxide. In a more particular embodiment thereof, the adjuvant has a greater amount of aluminum phosphate than aluminum hydroxide, such as a ratio of 2:1, 3:1, 4:1, 5:1, 6:1, 7:1, 8:1, 9:1 or greater than 9:1, by weight aluminum phosphate to aluminum hydroxide. More particular still, aluminum salts in the vaccine are present at 0.4 to 1.0 mg per vaccine dose, or 0.4 to 0.8 mg per vaccine dose, or 0.5 to 0.7 mg per vaccine dose, or about 0.6 mg per vaccine dose.

Generally, the preferred aluminum-based adjuvant(s), or ratio of multiple aluminum-based adjuvants, such as aluminum phosphate to aluminum hydroxide is selected by optimization of electrostatic attraction between molecules such that the antigen carries an opposite charge as the adjuvant at the desired pH. For example, aluminum phosphate adjuvant (isoelectric point=4) adsorbs lysozyme, but not albumin at pH 7.4. Should albumin be the target, aluminum hydroxide adjuvant would be selected (iep 11.4). Alternatively, pretreatment of aluminum hydroxide with phosphate lowers its isoelectric point, making it a preferred adjuvant for more basic antigens.

B. Oil-Emulsions

Oil-emulsion compositions suitable for use as adjuvants in the invention include squalene-water emulsions, such as MF59 (5% Squalene, 0.5% TWEEN™ 80, and 0.5% Span 85, formulated into submicron particles using a microfluidizer). See WO90/14837. See also, Podda, Vaccine (2001) 19: 2673-2680; Frey et al., Vaccine (2003) 21:4234-4237. MF59 is used as the adjuvant in the FLUAD™ influenza virus trivalent subunit vaccine.

Particularly preferred adjuvants for use in the compositions are submicron oil-in-water emulsions. Preferred submicron oil-in-water emulsions for use herein are squalene/water emulsions optionally containing varying amounts of MTP-PE, such as a submicron oil-in-water emulsion containing 4-5% w/v squalene, 0.25-1.0% w/v TWEEN™ 80 (polyoxyelthylenesorbitan monooleate), and/or 0.25-1.0% SPAN 85™ (sorbitan trioleate), and, optionally, N-acetylmuramyl-L-alanyl-D-isogluatminyl-L-alanine-2-(1'-2'-dipalmitoyl-sn-glycero-3-huydroxyphosphosphoryloxy)-ethylamine (MTP-PE), for example, the submicron oil-in-water emulsion known as "MF59" (International Publication No. WO90/14837; U.S. Pat. Nos. 6,299,884 and 6,451,325, and Ott et al., in Vaccine Design The Subunit and Adjuvant Approach (Powell, M. F. and Newman, M. J. eds.) Plenum Press, New York, 1995, pp. 277-296). MF59 contains 4-5% w/v Squalene (e.g 4.3%), 0.25-0.5% w/v TWEEN™ 80, and 0.5% w/v SPAN 85™ and optionally contains various amounts of MTP-PE, formulated into submicron particles using a microfluidizer such as Model 110Y microfluidizer (Microfluidics, Newton, Mass.). For example, MTP-PE may be present in an amount of about 0-500 μg/dose, more preferably 0-250 μg/dose and most preferably, 0-100 μg/dose. As used herein, the term "MF59-0" refers to the above submicron oil-in-water emulsion lacking MTP-PE, while the term MF59-MTP denotes a formulation that contains MTP-PE. For instance, "MF59-100" contains 100 μg MTP-PE per dose, and so on. MF69, another submicron oil-in-water emulsion for use herein, contains 4.3% w/v squalene, 0.25% w/v TWEEN™ 80, and 0.75% w/v SPAN 85™ and optionally MTP-PE. Yet another submicron oil-in-water emulsion is MF75, also known as SAF, containing 10% squalene, 0.4% TWEEN™ 80, 5% pluronic-blocked polymer L121, and thr-MDP, also microfluidized into a submicron emulsion. MF75-MTP denotes an MF75 formulation that includes MTP, such as from 100-400 μg MTP-PE per dose.

Submicron oil-in-water emulsions, methods of making the same and immunostimulating agents, such as muramyl peptides, for use in the compositions, are described in detail in WO90/14837 and U.S. Pat. Nos. 6,299,884 and 6,451,325.

Complete Freund's adjuvant (CFA) and incomplete Freund's adjuvant (IFA) may also be used as adjuvants in the invention.

C. Saponin Formulations

Saponin formulations, may also be used as adjuvants in the invention. Saponins are a heterologous group of sterol glycosides and triterpenoid glycosides that are found in the bark, leaves, stems, roots and even flowers of a wide range of plant species. Saponins isolated from the bark of the *Quillaia saponaria* Molina tree have been widely studied as adjuvants. Saponins can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs.

Saponin compositions have been purified using High Performance Thin Layer Chromatography (HP-TLC) and Reversed Phase High Performance Liquid Chromatography (RP-HPLC). Specific purified fractions using these techniques have been identified, including QS7, QS17, QS18, QS21, QH-A, QH-B and QH-C. Preferably, the saponin is QS21. A method of production of QS21 is disclosed in U.S. Pat. No. 5,057,540. Saponin formulations may also comprise a sterol, such as cholesterol (see WO96/33739).

Combinations of saponins and cholesterols can be used to form unique particles called Immunostimulating Complexes (ISCOMs). ISCOMs typically also include a phospholipid such as phosphatidylethanolamine or phosphatidylcholine. Any known saponin can be used in ISCOMs. Preferably, the ISCOM includes one or more of Quil A, QHA and QHC. ISCOMs are further described in EP0109942, WO96/11711 and WO96/33739. Optionally, the ISCOMS may be devoid of (an) additional detergent(s). See WO00/07621.

A review of the development of saponin based adjuvants can be found in Barr, et al., Advanced Drug Delivery Reviews (1998) 32:247-271. See also Sjolander, et al., Advanced Drug Delivery Reviews (1998) 32:321-338.

D. Virosomes and Virus Like Particles (VLPs)

Virosomes and Virus Like Particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in WO03/024480, WO03/024481, and Niikura et al, Virology (2002) 293:273-280; Lenz et al., Journal of Immunology (2001) 5246-5355; Pinto, et al., Journal of Infectious Diseases (2003) 188:327-338; and Gerber et al., Journal of Virology (2001) 75(10):4752-4760. Virosomes are discussed further in, for example, Gluck et al., Vaccine (2002) 20:B10-B16. Immunopotentiating reconstituted influenza virosomes (IRIV) are used as the subunit antigen delivery system in the intranasal trivalent INFLEXAL™ product {Mischler & Metcalfe (2002) Vaccine 20 Suppl 5:B 17-23} and the INFLUVAC PLUS™ product.

E. Bacterial or Microbial Derivatives

Adjuvants suitable for use in the invention include bacterial or microbial derivatives such as:

(1) Non-toxic derivatives of enterobacterial lipopolysaccharide (LPS)

Such derivatives include Monophosphoryl lipid A (MPL) and 3-O-deacylated MPL (3dMPL). 3dMPL is a mixture of 3 De-O-acylated monophosphoryl lipid A with 4, 5 or 6 acylated chains. A preferred "small particle" form of 3 De-O-acylated monophosphoryl lipid A is disclosed in EP 0 689 454. Such "small particles" of 3dMPL are small enough to be sterile filtered through a 0.22 micron membrane (see EP 0 689 454). Other non-toxic LPS derivatives include monophosphoryl lipid A mimics, such as aminoalkyl glucosaminide phosphate derivatives e.g RC 529. See Johnson et al. (1999) Bioorg Med Chem Lett 9:2273-2278.

(2) Lipid A Derivatives

Lipid A derivatives include derivatives of lipid A from *Escherichia coli* such as OM-174. OM-174 is described for example in Meraldi et al., Vaccine (2003) 21:2485-2491; and Pajak, et al., Vaccine (2003) 21:836-842.

(3) Immunostimulatory Oligonucleotides

Immunostimulatory oligonucleotides suitable for use as adjuvants in the invention include nucleotide sequences containing a CpG motif (a sequence containing an unmethylated cytosine followed by guanosine and linked by a phosphate bond). Bacterial double stranded RNA or oligonucleotides containing palindromic or poly(dG) sequences have also been shown to be immunostimulatory.

The CpG's can include nucleotide modifications/analogs such as phosphorothioate modifications and can be double-stranded or single-stranded. Optionally, the guanosine may be replaced with an analog such as 2'-deoxy-7-deazaguanosine. See Kandimalla, et al., Nucleic Acids Research (2003) 31(9): 2393-2400; WO02/26757 and WO99/62923 for examples of possible analog substitutions. The adjuvant effect of CpG oligonucleotides is further discussed in Krieg, Nature Medicine (2003) 9(7): 831-835; McCluskie, et al., FEMS Immunology and Medical Microbiology (2002) 32:179-185; WO98/40100; U.S. Pat. No. 6,207,646; U.S. Pat. No. 6,239,116 and U.S. Pat. No. 6,429,199.

The CpG sequence may be directed to TLR9, such as the motif GTCGTT or TTCGTT. See Kandimalla, et al., Biochemical Society Transactions (2003) 31 (part 3): 654-658. The CpG sequence may be specific for inducing a Th1 immune response, such as a CpG-A ODN, or it may be more specific for inducing a B cell response, such a CpG-B ODN.

CpG-A and CpG-B ODNs are discussed in Blackwell, et al., J. Immunol. (2003) 170(8):4061-4068; Krieg, TRENDS in Immunology (2002) 23(2): 64-65 and WO01/95935. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, Kandimalla, et al., BBRC (2003) 306:948-953; Kandimalla, et al., Biochemical Society Transactions (2003) 31(part 3):664-658; Bhagat et al., BBRC (2003) 300:853-861 and WO03/035836.

(4) ADP-ribosylating toxins and detoxified derivatives thereof.

Bacterial ADP-ribosylating toxins and detoxified derivatives thereof may be used as adjuvants in the invention. Preferably, the protein is derived from E. coli (i.e., E. coli heat labile enterotoxin "LT), cholera ("CT"), or pertussis ("PT"). The use of detoxified ADP-ribosylating toxins as mucosal adjuvants is described in WO95/17211 and as parenteral adjuvants in WO98/42375. Preferably, the adjuvant is a detoxified LT mutant such as LT-K63, LT-R72, and LTR192G. The use of ADP-ribosylating toxins and detoxified derivatives thereof, particularly LT-K63 and LT-R72, as adjuvants can be found in the following references: Beignon, et al., Infection and Immunity (2002) 70(6):3012-3019; Pizza, et al, Vaccine (2001) 19:2534-2541; Pizza, et al., Int. J. Med. Microbiol. (2000) 290(4-5):455-461; Scharton-Kersten et al., Infection and Immunity (2000) 68(9):5306-5313; Ryan et al., Infection and Immunity (1999) 67(12):6270-6280; Partidos et al., Immunol. Lett. (1999) 67(3):209-216; Peppoloni et al., Vaccines (2003) 2(2):285-293; and Pine et al., (2002) J. Control Release (2002) 85(1-3):263-270. Numerical reference for amino acid substitutions is preferably based on the alignments of the A and B subunits of ADP-ribosylating toxins set forth in Domenighini et al., Mol. Microbiol. (1995) 15(6): 1165-1167.

F. Bioadhesives and Mucoadhesives

Bioadhesives and mucoadhesives may also be used as adjuvants in the invention. Suitable bioadhesives include esterified hyaluronic acid microspheres (Singh et al. (2001) J. Cont. Rele. 70:267-276) or mucoadhesives such as cross-linked derivatives of polyacrylic acid, polyvinyl alcohol, polyvinyl pyrollidone, polysaccharides and carboxymethylcellulose. Chitosan and derivatives thereof may also be used as adjuvants in the invention. See WO99/27960.

G. Microparticles

Microparticles may also be used as adjuvants in the invention. Microparticles (i.e. a particle of ~100 nm to ~150 µm in diameter, more preferably ~200 nm to ~30 µm in diameter, and most preferably ~500 nm to ~10 µm in diameter) formed from materials that are biodegradable and non toxic (e.g. a poly(α-hydroxy acid), a polyhydroxybutyric acid, a polyorthoester, a polyanhydride, a polycaprolactone, etc.), with poly(lactide co glycolide) are preferred, optionally treated to have a negatively-charged surface (e.g. with SDS) or a positively-charged surface (e.g. with a cationic detergent, such as CTAB).

H. Liposomes

Examples of liposome formulations suitable for use as adjuvants are described in U.S. Pat. No. 6,090,406, U.S. Pat. No. 5,916,588, and EP 0 626 169.

I. Polyoxyethylene ether and Polyoxyethylene Ester Formulations

Adjuvants suitable for use in the invention include polyoxyethylene ethers and polyoxyethylene esters. WO99/52549. Such formulations further include polyoxyethylene sorbitan ester surfactants in combination with an octoxynol (WO01/21207) as well as polyoxyethylene alkyl ethers or ester surfactants in combination with at least one additional non-ionic surfactant such as an octoxynol (WO01/21152).

Preferred polyoxyethylene ethers are selected from the following group: polyoxyethylene-9-lauryl ether (laureth 9), polyoxyethylene-9-steoryl ether, polyoxytheylene-8-steoryl ether, polyoxyethylene-4-lauryl ether, polyoxyethylene-35-lauryl ether, and polyoxyethylene-23-lauryl ether.

J. Polyphosphazene (PCPP)

PCPP formulations are described, for example, in Andrianov et al., "Preparation of hydrogel microspheres by coacervation of aqueous polyphophazene solutions", Biomaterials (1998) 19(1-3):109-115 and Payne et al., "Protein Release from Polyphosphazene Matrices", Adv. Drug. Delivery Review (1998) 31(3):185-196.

K. Muramyl Peptides

Examples of muramyl peptides suitable for use as adjuvants in the invention include N-acetyl-muramyl-L-threonyl-D-isoglutamine (thr-MDP), N-acetyl-normuramyl-1-alanyl-d-isoglutamine (nor-MDP), and N acetylmuramyl-1-alanyl-d-isoglutaminyl-1-alanine-2-(1'-2'-dipalmitoyl-sn-glycero-3-hydroxyphosphoryloxy)-ethylamine MTP-PE).

L. Imidazoquinoline Compounds.

Examples of imidazoquinoline compounds suitable for use adjuvants in the invention include Imiquimod and its analogues, described further in Stanley, Clin Exp Dermatol (2002) 27(7):571-577; Jones, Curr Opin Investig Drugs (2003) 4(2):214-218; and U.S. Pat. Nos. 4,689,338, 5,389, 640, 5,268,376, 4,929,624, 5,266,575, 5,352,784, 5,494,916, 5,482,936, 5,346,905, 5,395,937, 5,238,944, and 5,525,612.

M. Thiosemicarbazone Compounds

Examples of thiosemicarbazone compounds, as well as methods of formulating, manufacturing, and screening for compounds all suitable for use as adjuvants in the invention include those described in WO04/60308. The thiosemicarbazones are particularly effective in the stimulation of human peripheral blood mononuclear cells for the production of cytokines, such as TNF-α.

N. Tryptanthrin Compounds

Examples of tryptanthrin compounds, as well as methods of formulating, manufacturing, and screening for compounds all suitable for use as adjuvants in the invention include those described in WO04/64759. The tryptanthrin compounds are particularly effective in the stimulation of human peripheral blood mononuclear cells for the production of cytokines, such as TNF-α.

The invention may also comprise combinations of aspects of one or more of the adjuvants identified above. For example, the following adjuvant compositions may be used in the invention:

(1) a saponin and an oil-in-water emulsion (WO99/11241);
(2) a saponin (e.g., QS21)+a non-toxic LPS derivative (e.g 3dMPL) (see WO94/00153);
(3) a saponin (e.g., QS21)+a non-toxic LPS derivative (e.g. 3dMPL)+a cholesterol;
(4) a saponin (e.g., QS21)+3dMPL+IL 12 (optionally+a sterol) (WO98/57659);
(5) combinations of 3dMPL with, for example, QS21 and/ or oil-in-water emulsions (See European patent applications 0835318, 0735898 and 0761231);
(6) SAF, containing 10% Squalane, 0.4% Tween 80, 5% pluronic-block polymer L121, and thr-MDP, either microfluidized into a submicron emulsion or vortexed to generate a larger particle size emulsion.
(7) Ribi™ adjuvant system (RAS), (Ribi Immunochem) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (DetoX™); and (8) one or more mineral salts (such as an aluminum salt)+a non-toxic derivative of LPS (such as 3dPML).

(9) one or more mineral salts (such as an aluminum salt)+ an immunostimulatory oligonucleotide (such as a nucleotide sequence including a CpG motif).

O. Human Immunomodulators

Human immunomodulators suitable for use as adjuvants in the invention include cytokines, such as interleukins (e.g. IL-1, IL-2, IL-4, IL-5, IL-6, IL-7, IL-12, etc.), interferons (e.g. interferon-γ), macrophage colony stimulating factor, and tumor necrosis factor.

Aluminum salts and MF59 are preferred adjuvants for use with injectable influenza vaccines. Bacterial toxins and bioadhesives are preferred adjuvants for use with mucosally-delivered vaccines, such as nasal vaccines.

The contents of all of the above cited patents, patent applications and journal articles are incorporated by reference as if set forth fully herein.

Therapeutic Methods

The invention provides methods for inducing or increasing an immune response to a GAS antigen using the compositions described above. The immune response is preferably protective and can include antibodies and/or cell-mediated immunity (including systemic and mucosal immunity). Immune responses include booster responses. Compositions comprising antibodies can be used to treat *S. pyogenes* infections.

Teenagers and children, including toddles and infants, can receive a vaccine for prophylactic use; therapeutic vaccines typically are administered to teenagers or adults. A vaccine intended for children may also be administered to adults e.g., to assess safety, dosage, immunogenicity, etc.

Diseases caused by *Streptococcus pyogenes* which can be prevented or treated according to the invention include, but are not limited to, pharyngitis (such as streptococcal sore throat), scarlet fever, impetigo, erysipelas, cellulitis, septicemia, toxic shock syndrome, necrotizing fasciitis, and sequelae such as rheumatic fever and acute glomerulonephritis. The compositions may also be effective against other streptococcal bacteria, e.g., GBS.

Tests to Determine the Efficacy of the Immune Response

One way of assessing efficacy of therapeutic treatment involves monitoring GAS infection after administration of the composition of the invention. One way of assessing efficacy of prophylactic treatment involves monitoring immune responses against the GAS antigens in the compositions of the invention after administration of the composition.

Another way of assessing the immunogenicity of the component proteins of the immunogenic compositions of the present invention is to express the proteins recombinantly and to screen patient sera or mucosal secretions by immunoblot. A positive reaction between the protein and the patient serum indicates that the patient has previously mounted an immune response to the protein in question; i.e., the protein is an immunogen. This method may also be used to identify immunodominant proteins and/or epitopes.

Another way of checking efficacy of therapeutic treatment involves monitoring GAS infection after administration of the compositions of the invention. One way of checking efficacy of prophylactic treatment involves monitoring immune responses both systemically (such as monitoring the level of IgG1 and IgG2a production) and mucosally (such as monitoring the level of IgA production) against the GAS antigens in the compositions of the invention after administration of the composition. Typically, GAS serum specific antibody responses are determined post-immunization but pre-challenge whereas mucosal GAS-specific antibody body responses are determined post-immunization and post-challenge.

The vaccine compositions of the present invention can be evaluated in in vitro and in vivo animal models prior to host, e.g., human, administration. Particularly useful mouse models include those in which intraperitoneal immunization is followed by either intraperitoneal challenge or intranasal challenge. A model in which intraperitoneal immunization is followed by intraperitoneal challenge is illustrated in FIG. 13.

The efficacy of immunogenic compositions of the invention can also be determined in vivo by challenging animal models of GAS infection, e.g., guinea pigs or mice, with the immunogenic compositions. The immunogenic compositions may or may not be derived from the same serotypes as the challenge serotypes. Preferably the immunogenic compositions are derivable from the same serotypes as the challenge serotypes. More preferably, the immunogenic composition and/or the challenge serotype are derivable from the group of GAS serotypes consisting of M1, M3, M23 and/or combinations thereof.

In vivo efficacy models include but are not limited to: (i) a murine infection model using human GAS serotypes; (ii) a murine disease model which is a murine model using a mouse-adapted GAS strain, such as the M23 strain which is particularly virulent in mice, and (iii) a primate model using human GAS isolates.

The immune response may be one or both of a TH1 immune response and a TH2 response. The immune response may be an improved or an enhanced or an altered immune response. The immune response may be one or both of a systemic and a mucosal immune response. Preferably the immune response is an enhanced system and/or mucosal response.

An enhanced systemic and/or mucosal immunity is reflected in an enhanced TH1 and/or TH2 immune response. Preferably, the enhanced immune response includes an increase in the production of IgG1 and/or IgG2a and/or IgA.

Preferably the mucosal immune response is a TH2 immune response. Preferably, the mucosal immune response includes an increase in the production of IgA.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH1 immune response may include one or more of an increase in CTLs, an increase in one or more of the cytokines associated with a TH1 immune response (such as IL-2, IFNγ, and TNFβ), an increase in activated macrophages, an increase in NK activity, or an increase in the production of IgG2a. Preferably, the enhanced TH1 immune response will include an increase in IgG2a production.

Immunogenic compositions of the invention, in particular, immunogenic composition comprising one or more GAS antigens of the present invention may be used either alone or in combination with other GAS antigens optionally with an immunoregulatory agent capable of eliciting a Th1 and/or Th2 response.

The invention also comprises an immunogenic composition comprising one or more immunoregulatory agent, such as a mineral salt, such as an aluminium salt and an oligonucleotide containing a CpG motif. Most preferably, the immunogenic composition includes both an aluminium salt and an oligonucleotide containing a CpG motif. Alternatively, the immunogenic composition includes an ADP ribosylating toxin, such as a detoxified ADP ribosylating toxin and an oligonucleotide containing a CpG motif. Preferably, one or more of the immunoregulatory agents include an adjuvant. The adjuvant may be selected from one or more of the group consisting of a TH1 adjuvant and TH2 adjuvant, further discussed below.

The compositions of the invention will preferably elicit both a cell mediated immune response as well as a humoral immune response in order to effectively address a GAS infection. This immune response will preferably induce long lasting (e.g., neutralizing) antibodies and a cell mediated immunity that can quickly respond upon exposure to one or more GAS antigens.

In one particularly preferred embodiment, the immunogenic composition comprises one or more GAS antigen(s) which elicits a neutralizing antibody response and one or more GAS antigen(s) which elicit a cell mediated immune response. In this way, the neutralizing antibody response prevents or inhibits an initial GAS infection while the cell-mediated immune response capable of eliciting an enhanced Th1 cellular response prevents further spreading of the GAS infection. Preferably, the immunogenic composition comprises one or more GAS surface antigens and one or more GAS cytoplasmic antigens. Preferably the immunogenic composition comprises one or more GAS40 surface antigens or the like and one or other antigens, such as a cytoplasmic antigen capable of eliciting a Th1 cellular response.

Compositions of the invention will generally be administered directly to a patient. The compositions of the present invention may be administered, either alone or as part of a composition, via a variety of different routes. Certain routes may be favored for certain compositions, as resulting in the generation of a more effective immune response, preferably a CMI response, or as being less likely to induce side effects, or as being easier for administration.

Delivery methods include parenteral injection (e.g., subcutaneous, intraperitoneal, intravenous, intramuscular, or interstitial injection) and rectal, oral (e.g., tablet, spray), vaginal, topical, transdermal (e.g., see WO 99/27961), transcutaneous (e.g., see WO02/074244 and WO02/064162), intranasal (e.g., see WO03/028760), ocular, aural, and pulmonary or other mucosal administration.

By way of example, the compositions of the present invention may be administered via a systemic route or a mucosal route or a transdermal route or it may be administered directly into a specific tissue. As used herein, the term "systemic administration" includes but is not limited to any parenteral routes of administration. In particular, parenteral administration includes but is not limited to subcutaneous, intraperitoneal, intravenous, intraarterial, intramuscular, or intrasternal injection, intravenous, intraarterial, or kidney dialytic infusion techniques. Preferably, the systemic, parenteral administration is intramuscular injection. As used herein, the term "mucosal administration" includes but is not limited to oral, intranasal, intravaginal, intrarectal, intratracheal, intestinal and ophthalmic administration.

Dosage treatment can be a single dose schedule or a multiple dose schedule. Multiple doses may be used in a primary immunization schedule and/or in a booster immunization schedule. In a multiple dose schedule the various doses may be given by the same or different routes e.g., a parenteral prime and mucosal boost, a mucosal prime and parenteral boost, etc.

The compositions of the invention may be prepared in various forms. For example, a composition can be prepared as an injectable, either as a liquid solution or a suspension. Solid forms suitable for solution in, or suspension in, liquid vehicles prior to injection can also be prepared (e.g., a lyophilized composition). A composition can be prepared for oral administration, such as a tablet or capsule, as a spray, or as a syrup (optionally flavored). A composition can be prepared for pulmonary administration, e.g., as an inhaler, using a fine powder or a spray. A composition can be prepared as a suppository or pessary. A composition can be prepared for nasal, aural or ocular administration e.g., as drops. A composition can be in kit form, designed such that a combined composition is reconstituted just prior to administration to a patient. Such kits may comprise one or more GAS or other antigens in liquid form and one or more lyophilized antigens.

Immunogenic compositions used as vaccines comprise an immunologically effective amount of GAS or other antigens (or nucleic acid molecules encoding the antigens) or antibodies, as well as any other components, as needed, such as antibiotics. An "immunologically effective amount" is an amount which, when administered to an individual, either in a single dose or as part of a series, increases a measurable immune response or prevents or reduces a clinical symptom.

The immunogenic compositions of the present invention may be administered in combination with an antibiotic treatment regime. In one embodiment, the antibiotic is administered prior to administration of the antigen of the invention or the composition comprising the one or more GAS antigens of the invention.

In another embodiment, the antibiotic is administered subsequent to the administration of the one or more surface-exposed and/or surface-associated GAS antigens of the invention or the composition comprising the one or more surface-exposed and/or surface-associated GAS antigens of the invention. Examples of antibiotics suitable for use in the treatment of a GAS infection include but are not limited to penicillin or a derivative thereof or clindamycin, cephalosporins, glycopeptides (e.g., vancomycin), and cycloserine.

The amount of active agent in a composition varies, however, depending upon the health and physical condition of the individual to be treated, age, the taxonomic group of individual to be treated (e.g., non-human primate, primate, etc.), the capacity of the individual's immune system to synthesize antibodies, the degree of protection desired, the formulation of the vaccine, the treating doctor's assessment of the medical situation, and other relevant factors. The amount will fall in a relatively broad range which can be determined through routine trials.

Kits

The invention also provides kits comprising one or more containers of compositions of the invention. Compositions can be in liquid form or can be lyophilized, as can individual antigens. Suitable containers for the compositions include, for example, bottles, vials, syringes, and test tubes. Containers can be formed from a variety of materials, including glass or plastic. A container may have a sterile access port (for example, the container may be an intravenous solution bag or a vial having a stopper pierceable by a hypodermic injection needle).

The kit can further comprise a second container comprising a pharmaceutically-acceptable buffer, such as phosphate-buffered saline, Ringer's solution, or dextrose solution. It can also contain other materials useful to the end-user, including other buffers, diluents, filters, needles, and syringes. The kit can also comprise a second or third container with another active agent, for example an antibiotic.

The kit can also comprise a package insert containing written instructions for methods of inducing immunity against *S. pyogenes* or for treating *S. pyogenes* infections. The package insert can be an unapproved draft package insert or can be a package insert approved by the Food and Drug Administration (FDA) or other regulatory body.

All patents, patent applications, and references cited in this disclosure are expressly incorporated herein by reference. The above disclosure generally describes the present invention. A more complete understanding can be obtained by reference to the following specific examples, which are provided for purposes of illustration only and are not intended to limit the scope of the invention.

EXAMPLE 1

Identification of Surface-Exposed GAS Antigens

A set of 73 proteins were identified in silico as surface-expressed proteins of the GASSF370 strain (M1) genome using BLAST, FASTa, MOTIFS, FINDPATTERNS, PSORT, and searches of the Propom, Pfam, and Blocks databases. These programs were used to predict features typical of surface-associated proteins, such as transmembrane domains, leader peptides, homologies to known surface proteins, lipoprotein signatures, outer membrane anchoring motifs, and host-cell binding domains such as RGD. The results are shown in Table 3.

Figure 4A:
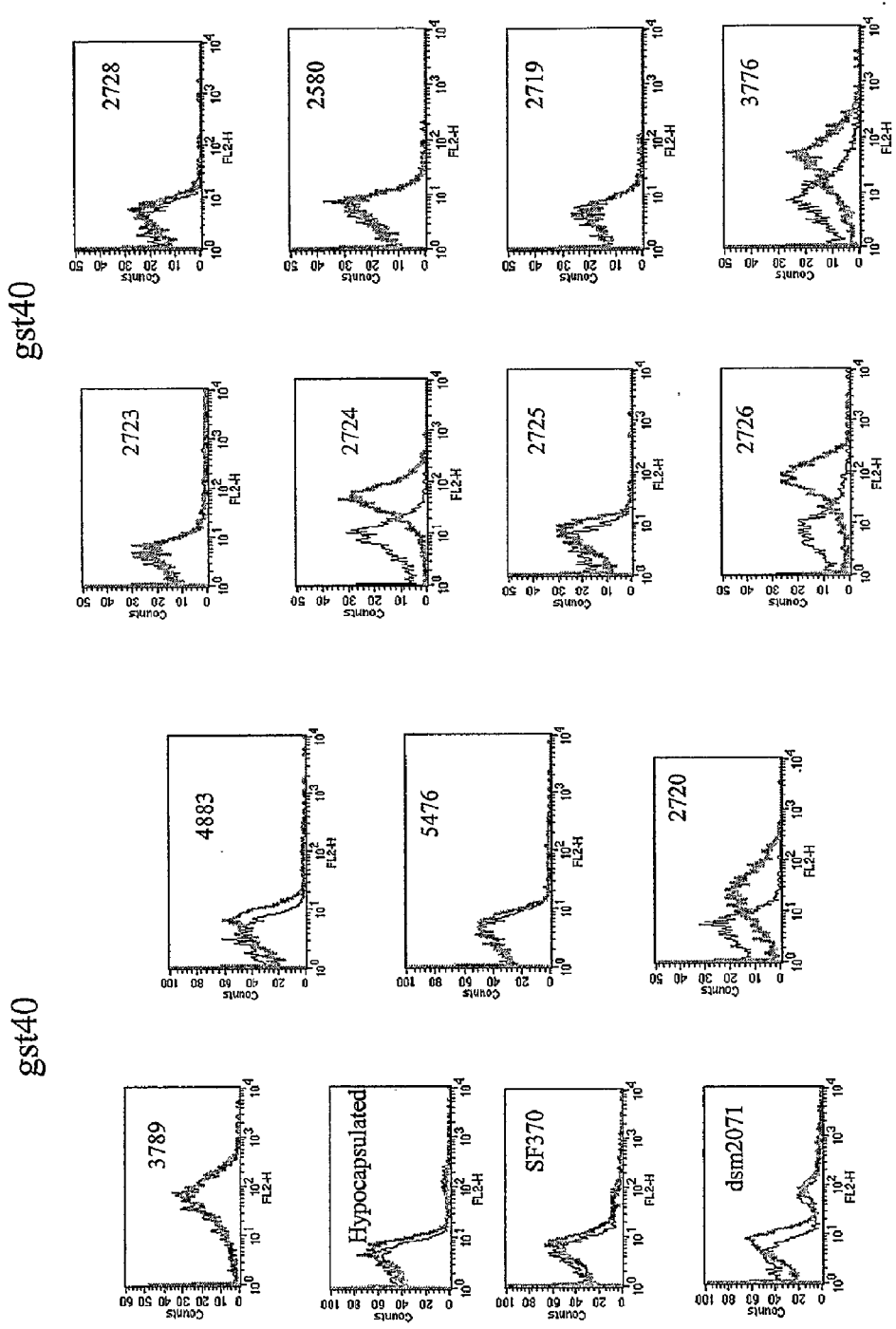
Figure 5A:
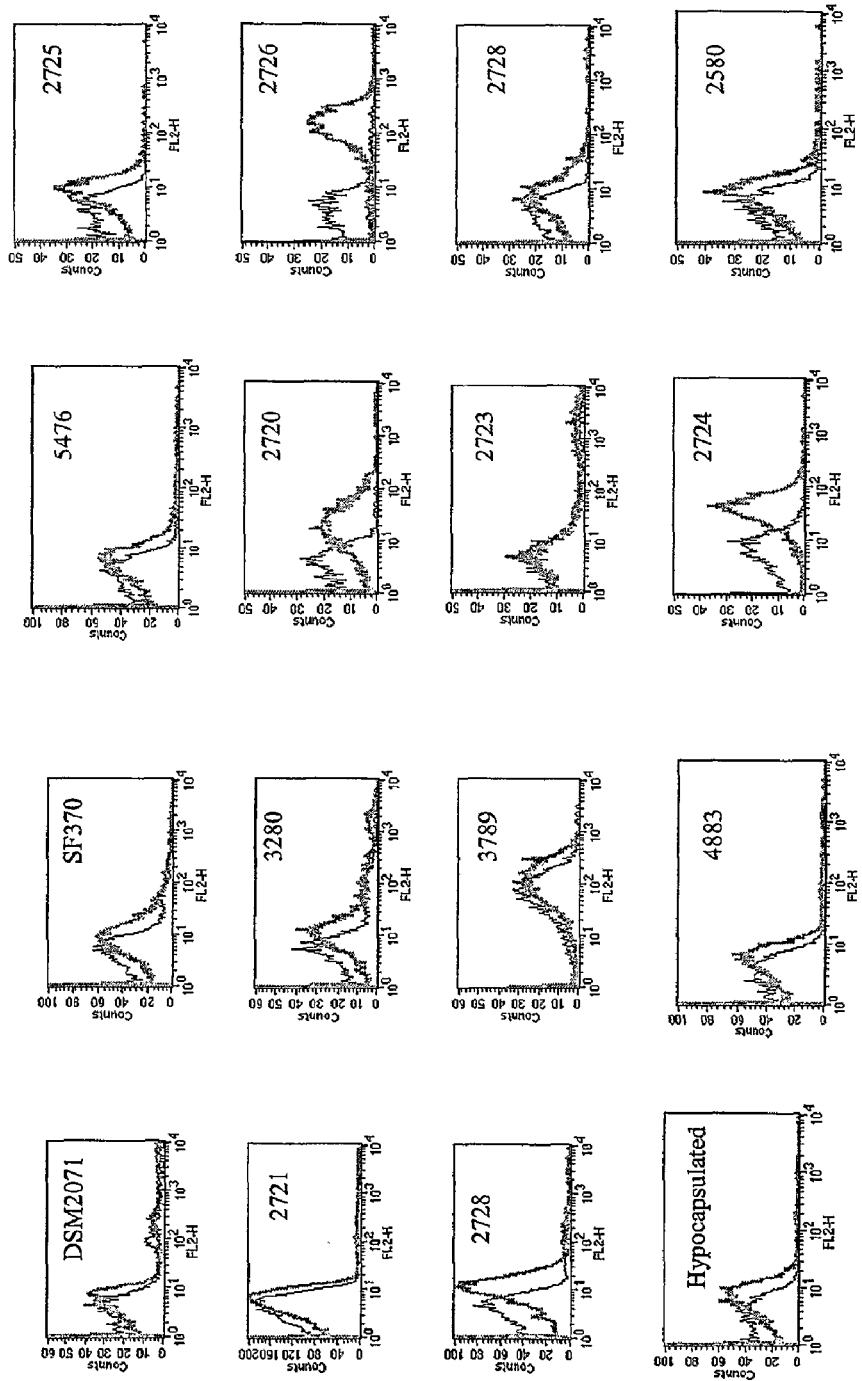
FIG. 5A-B. Results of FACS analysis demonstrating that antisera directed against a GAS40a antigen detects GAS40 protein on the cell surface of strains of different M types.
Figure 5B:
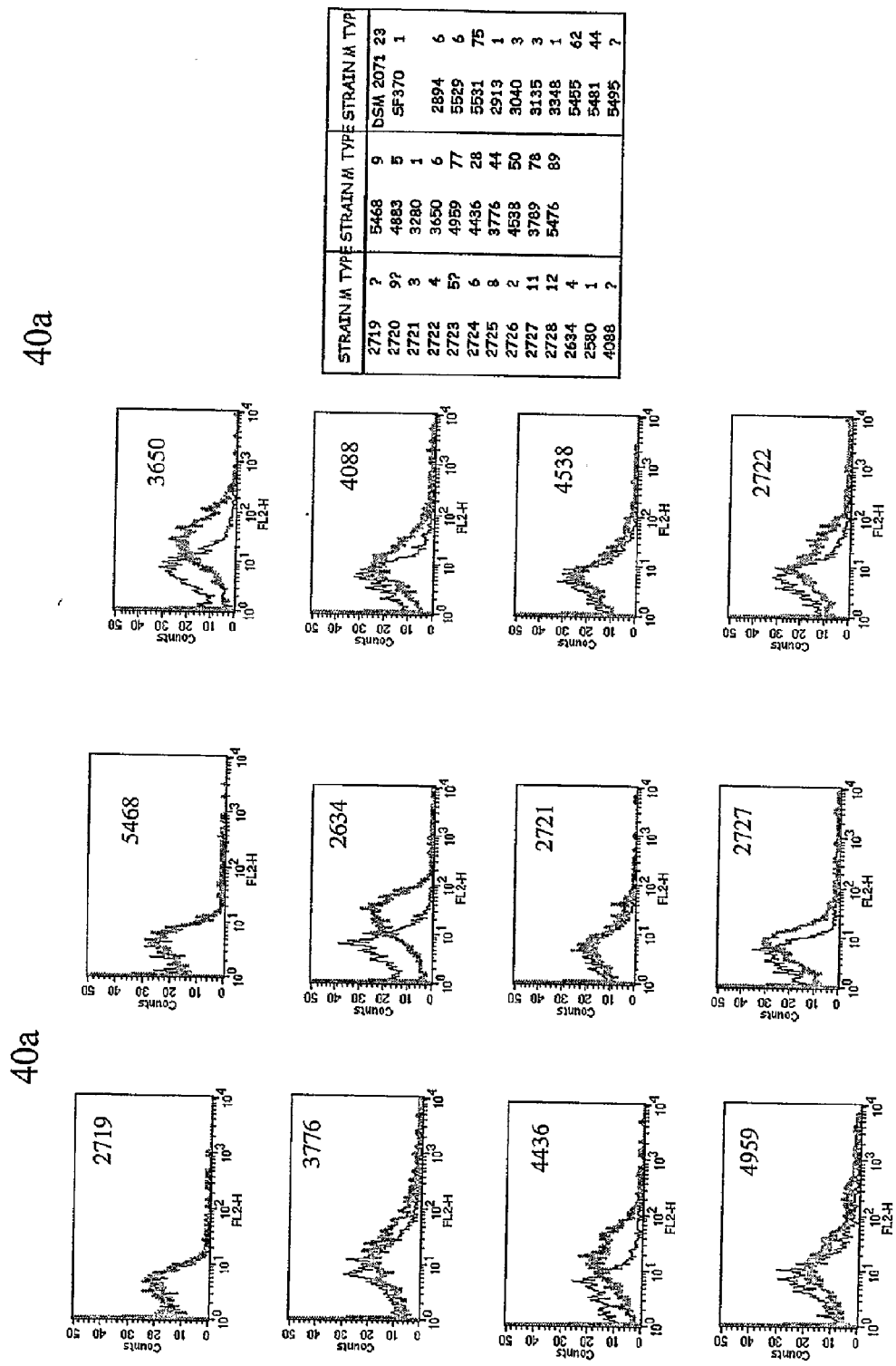
Figure 6A:
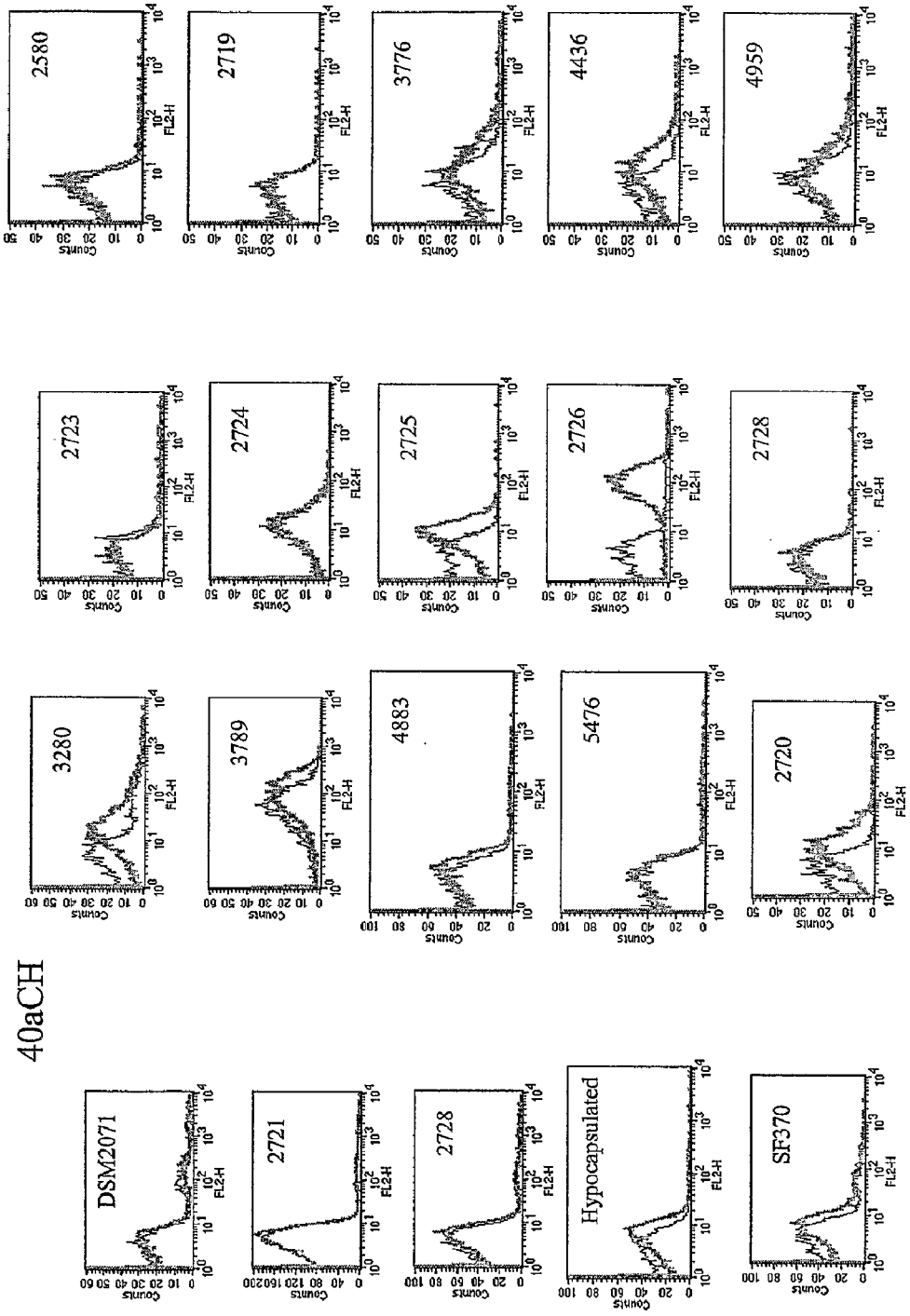
FIG. 6A-B. Results of FACS analysis demonstrating that antisera directed against a GAS40aCH antigen detects GAS40 protein on the cell surface of strains of different M types.
Figure 6B:
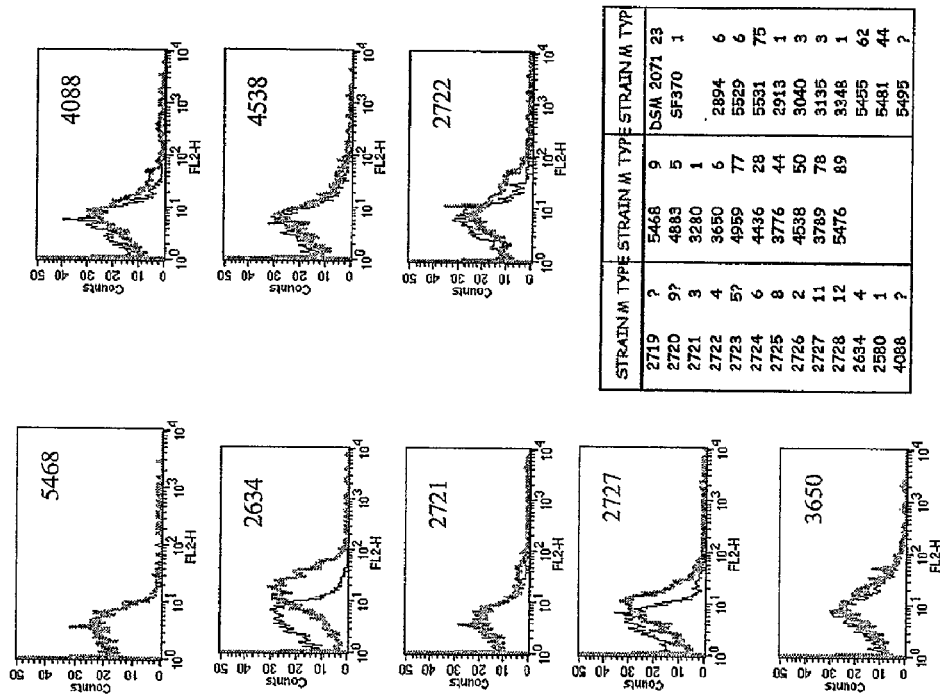
Figure 7:
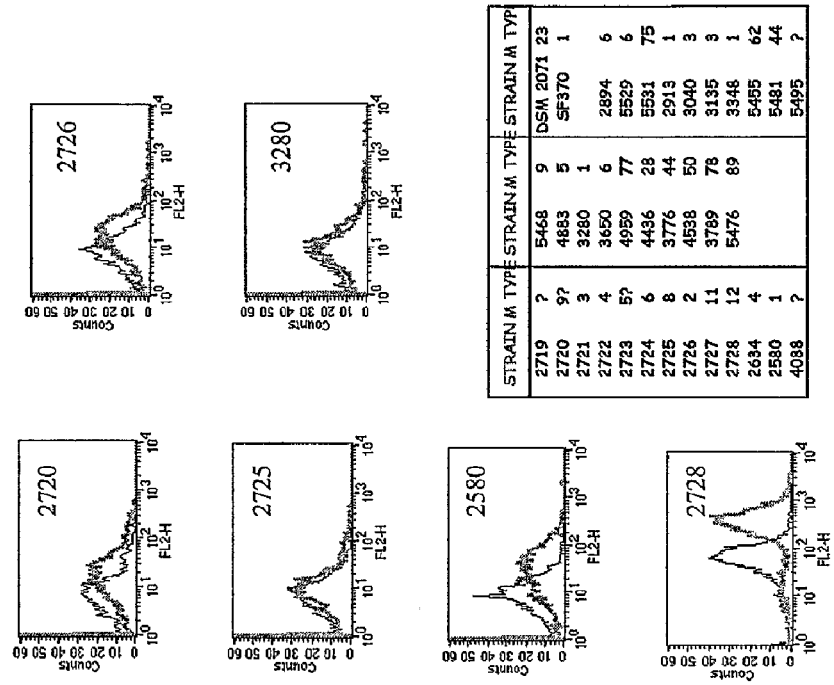
FIG. 7. Results of FACS analysis demonstrating that antisera directed against a GAS40/GAS117 hybrid antigen detects GAS40 protein on the cell surface of strains of different M types (strains 2720, 2726, 2725, 3280, 2580, 2728).
Figure 9A:
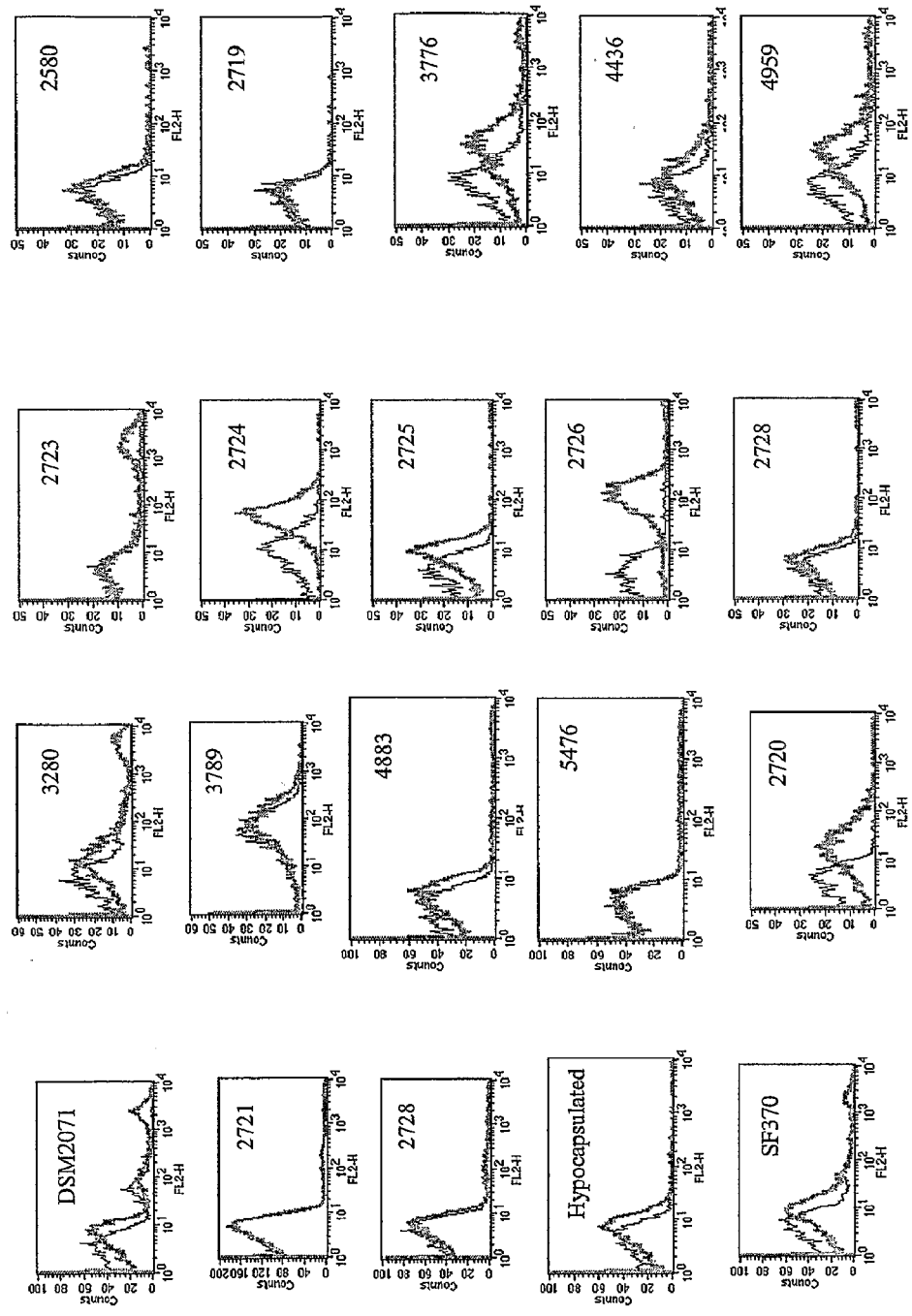
FIG. 9A-B. Results of FACS analysis demonstrating that antisera directed against a GAS40aRR antigen detects GAS40 protein on the cell surface of strains of different M types.
Figure 9B:
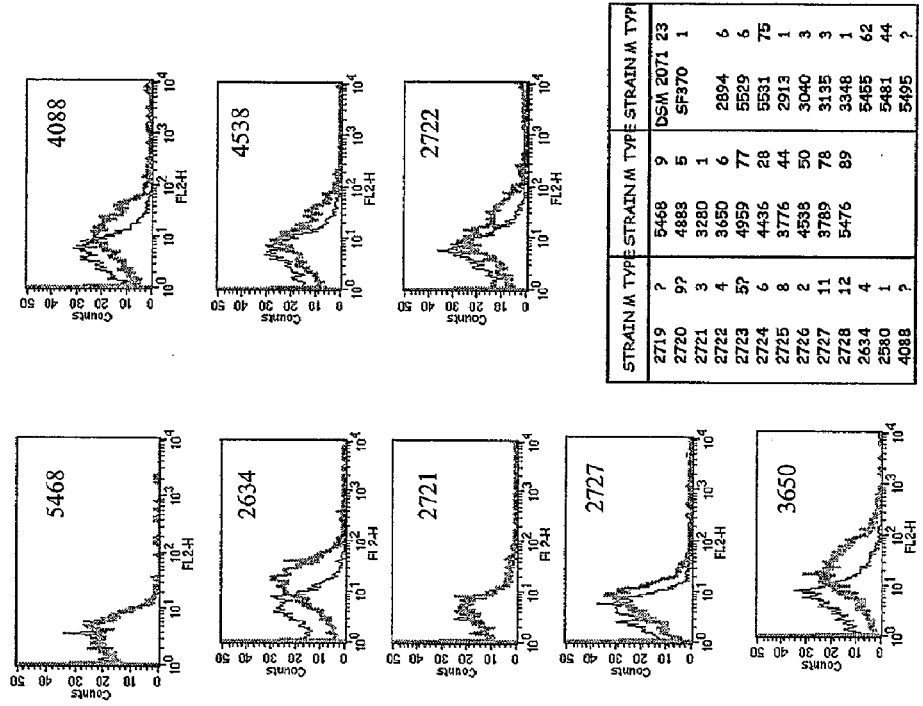
Figure 10A:
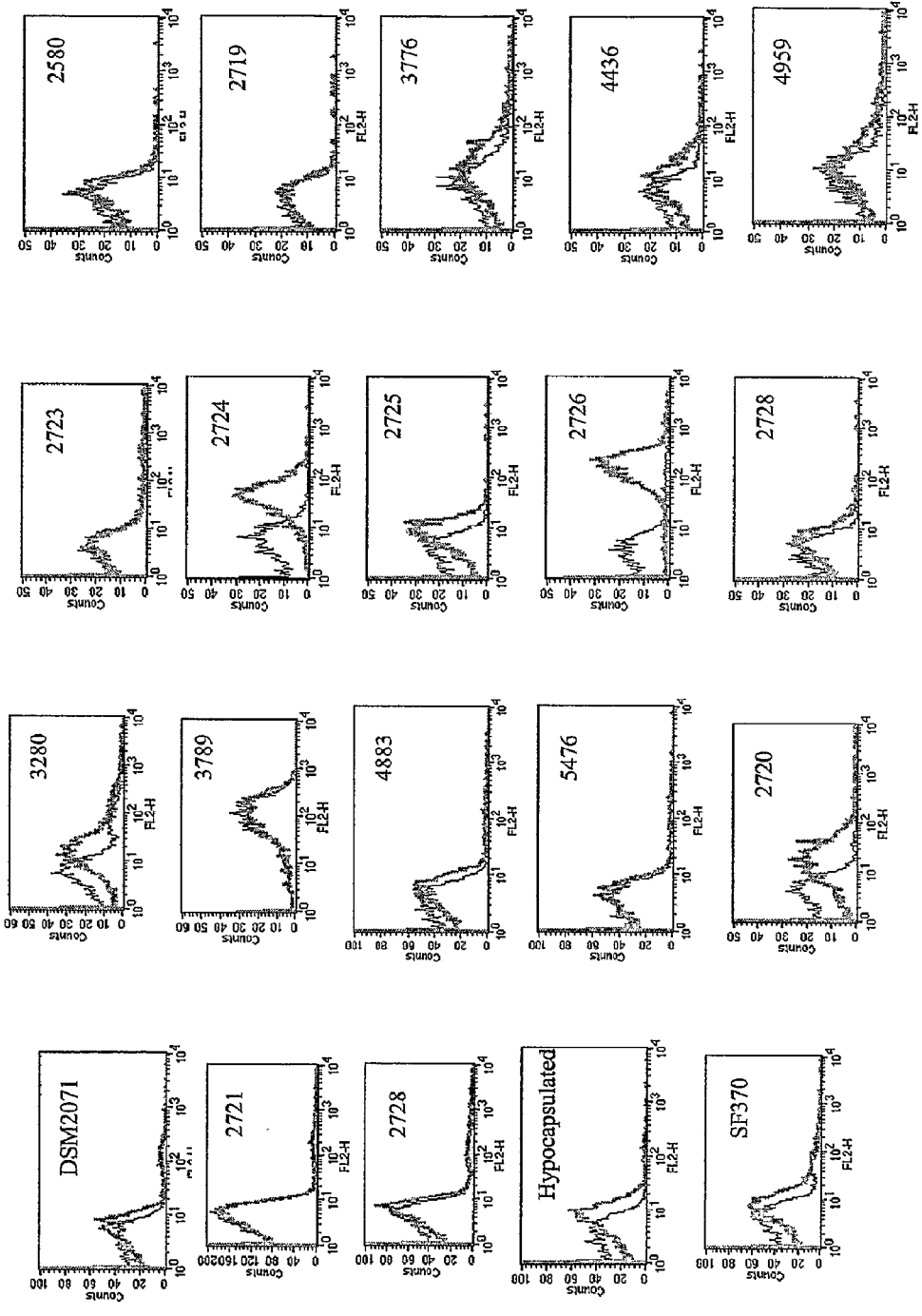
FIG. 10A-B. Results of FACS analysis demonstrating that antisera directed against a GAS40aNH antigen detects GAS40 protein on the cell surface of strains of different M types.
Figure 10B:
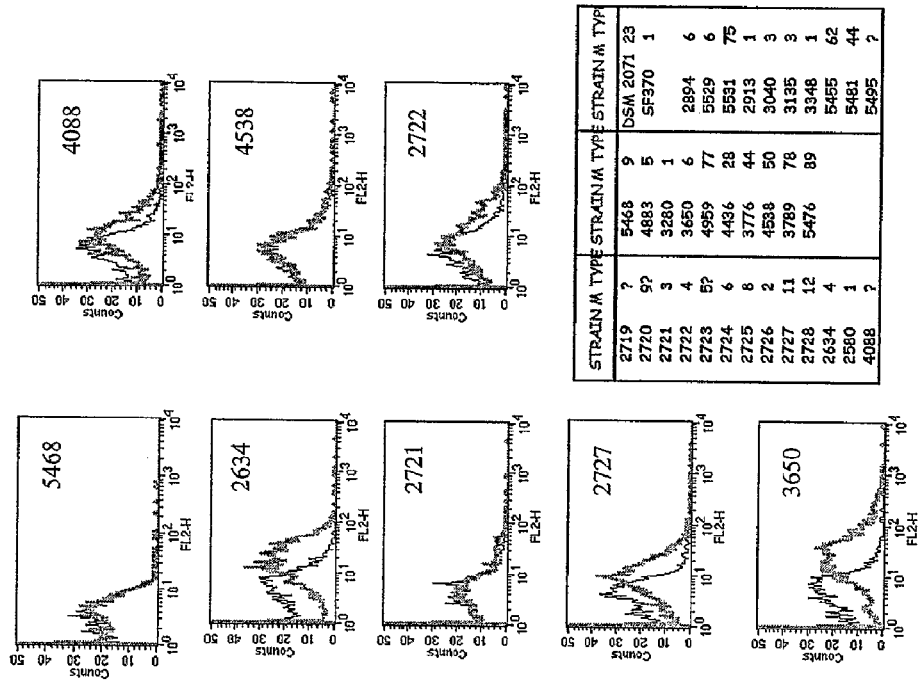
Figure 11A:
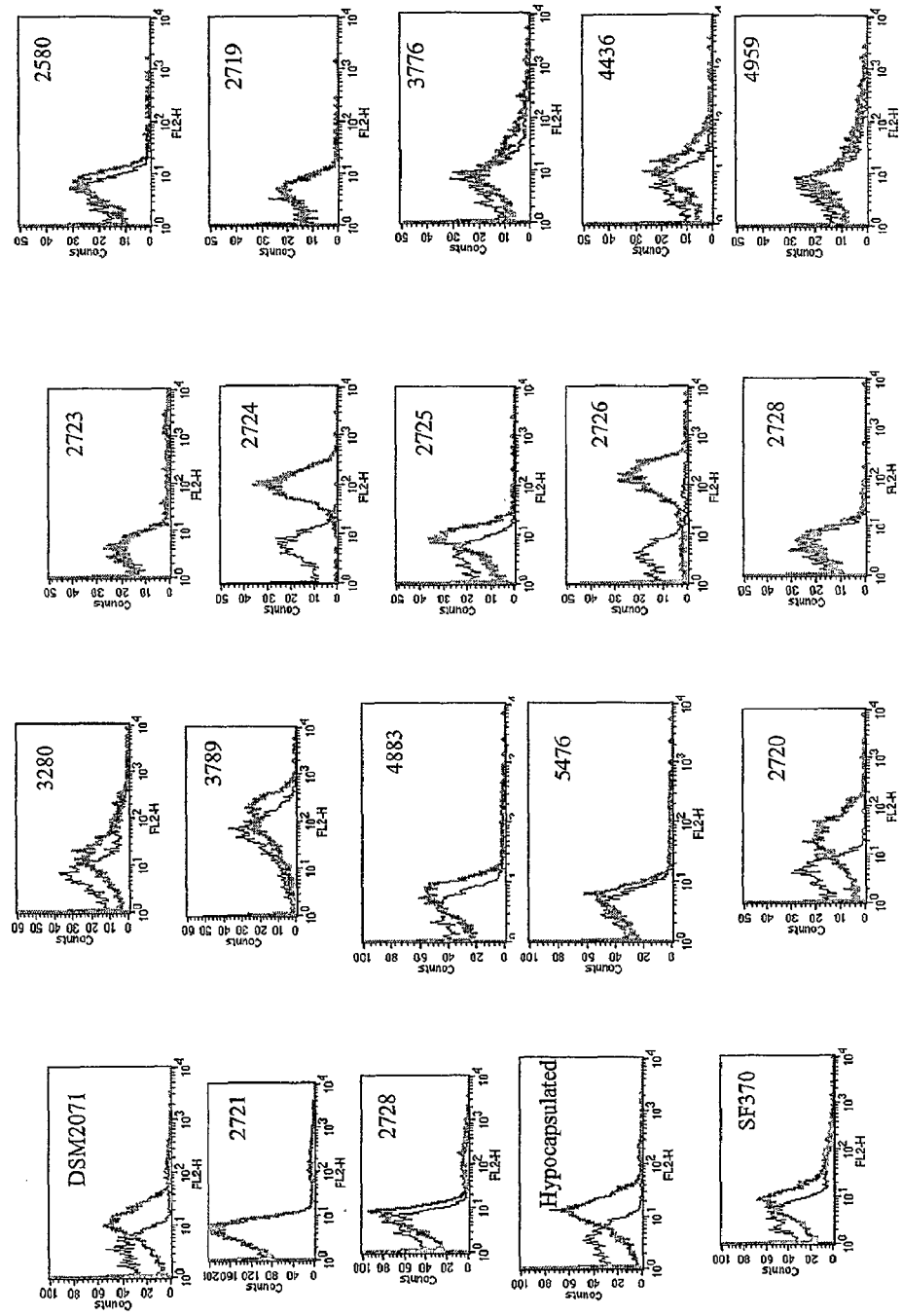
Figure 12B:
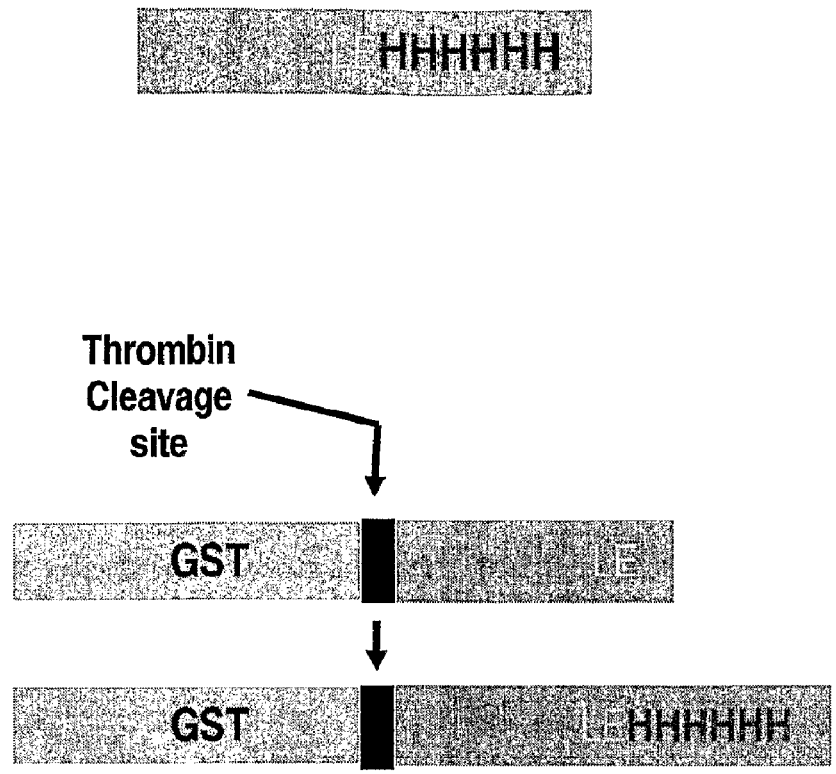

Commercially available *E. coli* expression vectors pET and pGex were used to express GAS antigens either as HIS-tagged proteins or as HIS-GST fusions, i.e., an amino-terminal histidine tag and a carboxy terminal GST (wherever "GST" is not specified, only the HIS-tagged antigen was expressed. See FIGS. 4A and 4B. In some cases, urea was used to solubilize the antigen. Briefly, PCR reactions were performed to amplify GAS antigen coding sequences, then the amplified products were digested overnight. The digested PCR products were then purified and ligated overnight with either pET or pGEX vectors. *E. coli* strains BL21(DE3) and BL21 were transformed with the pGEX and pET ligation products, respectively, plated, and incubated at 37° C. Two PCR-positive colonies from each transformation were inoculated and grown overnight. Protein expression in these clones was induced with IPTG and assessed by SDS-PAGE analysis of *E. coli* extracts. Glycerol batches of the GAS antigen-expressing clones were then prepared.

Two of the identified proteins (GAS87, 171) were not expressed. Mice were immunized with 70 of the other proteins. Sera of these mice were used for FACS analysis on native bacterial cells, and surface exposure was tested on 20 GAS strains of different M types (see Table 2). The presence or absence of each protein on the bacterial cell surface was assessed by calculating the difference (Delta Mean) between the FACS value obtained with the immune serum and that obtained with the preimmune serum. An arbitrary cut-off of Delta Mean ≧80 was used to classify a protein as "surface exposed." Three of the tested antigens did not meet this threshold (GAS88, 208, and 210). The results for the other GAS antigens tested are shown in Tables 4A-4R and FIG. 2.

EXAMPLE 2

GAS40 Protein Identity in Different GAS Strains

Genomic DNAs were prepared from GAS strains of different M types, and the complete protein sequence of the full-length GAS40 antigen was obtained. The results are shown in FIG. 1 and in Table 5.

EXAMPLE 3

Demonstration that GAS40 Proteins are Surface-Exposed

FACS analysis was carried out as described in Example 1 to demonstrate that GAS40 proteins are surface-exposed. The results are shown in FIG. 2.

EXAMPLE 4

FACS Analysis of Various GAS40 Antigens

Mice were immunized with various GAS40 antigens. Sera of these mice were used for FACS analysis on native bacterial cells of various *S. pyogenes* strains. The ability of these antisera to detect GAS40 protein on the bacterial cell surface was assessed by calculating the difference between the FACS value obtained with the immune sera and that obtained with the preimmune sera. The results are shown in FIGS. 3-11.

"40 native" (FIG. 3) is the GAS40 protein having the amino acid sequence shown in SEQ ID NO:17 and is encoded by a nucleotide sequence derived from the genomic sequence of the SF 370 strain.

"GST40" (FIGS. 4A-4B) is a hybrid GAS40 antigen with glutathione-S-transferase in place of the leader sequence at its N terminus. The N-terminal amino acids LVPRGSHM (SEQ ID NO:963) and the C-terminal amino acids AAALEHHH-HHH (SEQ ID NO:964) belong to the GST vector pGEX-NNH.

"40a" (FIGS. 5A-5B) is a GAS40 antigen with a HIS tag but without the leader and hydrophobic sequences (SEQ ID NO:235). The nucleotide sequence shown in SEQ ID NO:892 was cloned into vector pET21b+(Novagen) using the NdeI and NotI restriction sites. The carboxyl terminal 12 amino acids were introduced with the vector. Codon 824 (AGA in the wild-type sequence) was mutagenized to CGT.

"40aCH" (FIGS. 6A-6B) is a GAS40 antigen with a HIS tag at its carboxyl terminus and two additional amino acids at its N terminus. Three nucleotide changes introduced with the cloning of its coding sequence into the pSM214gCH shuttle vector (at nucleotides 198, 222, and 1115). One amino acid (amino acid 372) was changed from Phe to Ser.

"40/117" (FIG. 7) is a GAS40 hybrid antigen in which the GAS40 protein is placed to the N-terminus of the GAS117 protein and a HIS tag is added to the C terminus of the GAS117 protein (SEQ ID NO:234). SEQ ID NO:891 is a nucleotide sequence which codes for this antigen.

"117/40" (FIG. 8) is a GAS40 hybrid antigen in which GAS117 to GAS40 by the linker sequence YASGGGS (SEQ ID NO:278). Its amino acid sequence is shown in SEQ ID NO:233; a coding sequence is shown in SEQ ID NO:890.

"40aRR" (FIGS. 9A-9B) is similar to "40a" except that two additional AGA codons (334 and 335) in the coding sequence were mutated to CGT.

"40aNH" (FIGS. 10A-10B) is a GAS40 antigen with the HIS tag at its N terminus. Its coding sequence was cloned into the E. coli/B. subtilis expression shuttle vector pSM214gNH, which uses a constitutive promoter instead of an IPTG inducible promoter. The amino terminal nine amino acids are introduced with the cloning. It contains two nucleotide changes which most likely occurred during PCR amplification and do not result in amino acid changes (nucleotides 356 and 1547).

"40aRRNH" (FIGS. 11A-11B) is similar to "40aNH" except that codons 1034 and 1035 were modified to CGT.

EXAMPLE 5

Immunization of Mice

Groups of 10 CD1 female mice aged between 6 and 7 weeks are immunized with two or more GAS antigens of the invention, (20 μg of each recombinant GAS antigen), suspended in 100 μl of suitable solution. Each group received 3 doses at days 0, 21, and 45. Immunization was performed through intra-peritoneal injection of the protein with an equal volume of Complete Freund's Adjuvant (CFA) for the first dose and Incomplete Freund's Adjuvant (IFA) for the following two doses. In each immunization scheme negative and positive control groups were used. See FIG. 13.

For the negative control group, mice were immunized with E. coli proteins eluted from the purification columns following processing of total bacterial extract from an E. coli strain containing either the pET21b or the pGEX-NNH vector (thus expressing GST only) without any cloned GAS ORF (groups can be indicated as HisStop or GSTStop respectively). For the positive control groups, mice were immunized with purified GAS M cloned from either GAS SF370 or GAS DSM 2071 strains (groups indicated as 192SF and 192DSM respectively).

Pooled sera from each group was collected before the first immunization and two weeks after the last one. Mice were infected with GAS about a week after.

Immunized mice were infected using GAS strain 2071, a different strain from that used for the cloning of the selected proteins. (German Collection of Microorganisms and Cell Cultures, DSMZ).

For infection experiments, DSM 2071 was grown at 37° C. in THY broth until the $OD_{600}$ was 0.4. Bacteria were pelletted by centrifugation, washed once with PBS, suspended, and diluted with PBS to obtain the appropriate concentration of bacteria/ml and administered to mice by intraperitoneal injection. Between 50 and 100 bacteria were given to each mouse, as determined by plating aliquots of the bacterial suspension on 5 THY plates. Animals were observed daily and checked for survival. The results obtained after intraperitoneal challenge are shown in FIG. 22 and Table 6A. The results obtained after intranasal challenge are shown in Table 6B (note the increased survival rate).

EXAMPLE 6

Using the model described above, selected GAS antigens were tested and some of them showed statistically significant protection rates (FIG. 14). Of these, GAS40 appeared to be particularly promising, giving protection efficacy above 50% against mouse challenge with a heterologous GAS strain.

EXAMPLE 7

FACS Analysis

Bacteria were grown in THY to $OD_{600}$=0.4, washed twice with PBS, suspended in NCS (Newborn Calf Serum, Sigma), incubated for 20 min at RT, and dispensed in a 96-well plate (20 μl/well). Eighty μl of preimmune or immune mouse sera, diluted in PBS-0.1% BSA, were added to the bacterial suspension to a final dilution of 1:200 and incubation was performed on ice for 30 min. After washing twice with PBS-0.1% BSA, bacteria were incubated on ice for 30 min in 10 μl of Goat Anti-Mouse IgG, F(ab')$_2$ fragment-specific-R-Phycoerythrin-conjugated (Jackson Immunoresearch Laboratories Inc.) in PBS-0.1% BSA-20% NCS to a final dilution of 1:100.

Following incubation, bacteria were washed with PBS-0.1% BSA, suspended in 200 μl PBS and analyzed using a FACS Calibur cytometer (Becton Dikinson, Mountain View, Calif. USA) and Cell Quest Software (Becton Dikinson, Mountain View, Calif. USA). The results are shown in FIG. 17.

EXAMPLE 8

Distribution of GAS40 on the Bacterial Surface

Immunogold labeling and electron microscopy GAS were grown in THYE medium to mid-log phase, washed and resuspended in PBS. Formvar-carbon-coated nickel grids were floated on drops of GAS suspensions for 5 min, fixed in 2% PFA for 5 min, and placed in blocking solution (PBS containing 1% normal rabbit serum and 1% BSA) for 30 min. The grids were then floated on drops of primary antiserum diluted 1:20 in blocking solution for 30 min at RT, washed, and floated on secondary antibody conjugated to 10 nm gold particles diluted 1:10 in 1% BSA for 30 min.

The grids were washed with PBS then distilled water and air dried and examined using a TEM GEOL 1200EX II transmission electron microscope. Preimmune serum from the same animals were used as a negative control. The results are shown in FIG. 18.

EXAMPLE 9

Opsonophagocytosis and Bacterial Growth Inhibition

Preparation of Bacterial Inoculum

Bacterial cells were grown in THY medium until they reached the middle exponential phase (OD600 0.4) at 37° C. Bacteria were washed twice in chilled saline solution and suspended in MEM medium with the volume being adjusted for each strain depending on the amount of bacteria used. Bacterial cells were kept in ice until used in the assay.

Preparation of Peripheral Mononuclear Cells (PMN)

PMN were prepared from buffy coats of heparinized blood from healthy volunteers. The buffy coat was incubated for 30 minutes in a solution containing dextran, NaCl and Heparin (rate 1:1). After incubation the supernatant, enriched in leukocytes, was removed, transferred to a clean tube, and centrifuged at 700×g for 20 minutes. A short wash in water was performed to break red blood cells, and then a solution of NaCl was added to restore the appropriate salt concentration.

After this step cells were centrifuged, washed, and suspended in MEM at a suitable concentration.

Opsonophagocytosis Assay

GAS strains were incubated with heat inactivated immune mice serum (or preimmune for the control), human PMN, and baby rabbit complement for 1 hour of incubation at 37° C. Samples taken immediately before and after the incubation were plated on THY blood agar plates. Phagocytosis was evaluated comparing the difference in the number of colonies at the two times for the preimmune and the immune serum. Data were reported as logarithm number of grown colonies at t=0–logarithm number of grown colonies at t=60. See FIG. 20.

Bacterial Growth Inhibition

Complete heparinized blood from mice immunized with GAS40 was incubated with bacterial cells grown as described above. Blood of mice immunized only with protein buffer was used as a control. The samples were rotated end over end for 3 hours at 37° C. Reactions were plated on THY blood agar plates, and CFU were counted. Growth inhibition was evaluated by comparing the number of colonies in the samples and in the control. See FIG. 19.

EXAMPLE 10

Expression of GAS40

To test whether the GAS40 gene, which appears to be well conserved, was actually expressed in different strains, total cell extracts from a panel of distinct GAS strains were loaded on SDS-PAGE and probed with immune sera raised against the recombinant GAS40. As shown in FIG. 16, the protein is expressed at a detectable level in all the strains tested, although a certain level of variability is observed.

Cell extracts were obtained by growing the cells at 37° C. to $OD_{600}$ 0.32 in 10 ml of THY. The cell pellet was washed in PBS, resuspended in lysis buffer (40% sucrose, 0.1 M $KPO_4$ pH 6.2, $MgCl_2$ 10 mM, and Roche's COMPLETE™ EDTA-free), and digested for 3 hours with 400U of mutanolysin and 2 mg/ml lysozyme. The insoluble fraction was separated by centrifugation and the supernatant was analyzed.

EXAMPLE 11

Cloning of GAS40 Domains

Computational structural studies based on the amino acid sequence of GAS40 identified two potential coiled coil regions, one at the C-terminus and one at the N-terminus (see also WO 05/032582). This prediction was used to clone and express two isolated protein domains, one of predicted 305 (40N) amino acids and one of 568 amino acids (40C). Two sets of primers (see below) were used to amplify the two distinct coding regions by PCR, each containing one of the predicted coiled-coil domains:

```
                                             (SEQ ID NO: 965)
40N-F:  5'-GTGCGTCATATGCAAGTCAAAGCAGATGATA-3'

(SEQ ID NO: 966)
40N-R:  5'-ACTCGCTAGCGGCCGCTTGGTATTGATTTAAT
TGATTAC-3'

(SEQ ID NO: 967)
40C-F:  5'-GTGCGTCATATGGATATTCCAGCAGATCGTA-3'

(SEQ ID NO: 968)
40C-R:  5'-ACTCGCTAGCGGCCGCGACTCCTGCTTTAAGAGCT-3'
```

The DNA fragments were then cloned into pET21b+ and pGEX vectors and expressed in *E. coli*. Only the N-terminal domain gave a product of the expected size (40N). See FIG. 21. GAS40N consists of a 292 amino acid portion of GAS40 with a methionine at the start of the sequence and a polyhistidine tail at the end.

EXAMPLE 12

GAS40 is Surface-Exposed Across Different M Strains

FIG. 23 demonstrates that GAS40 is surface exposed across different M strains. The data were obtained using convalescent sera from patients with or recovered from a GAS infection.

EXAMPLE 13

GAS40N Does Not React with Four Anti-GAS40 Monoclonal Antibodies

Figure 24:
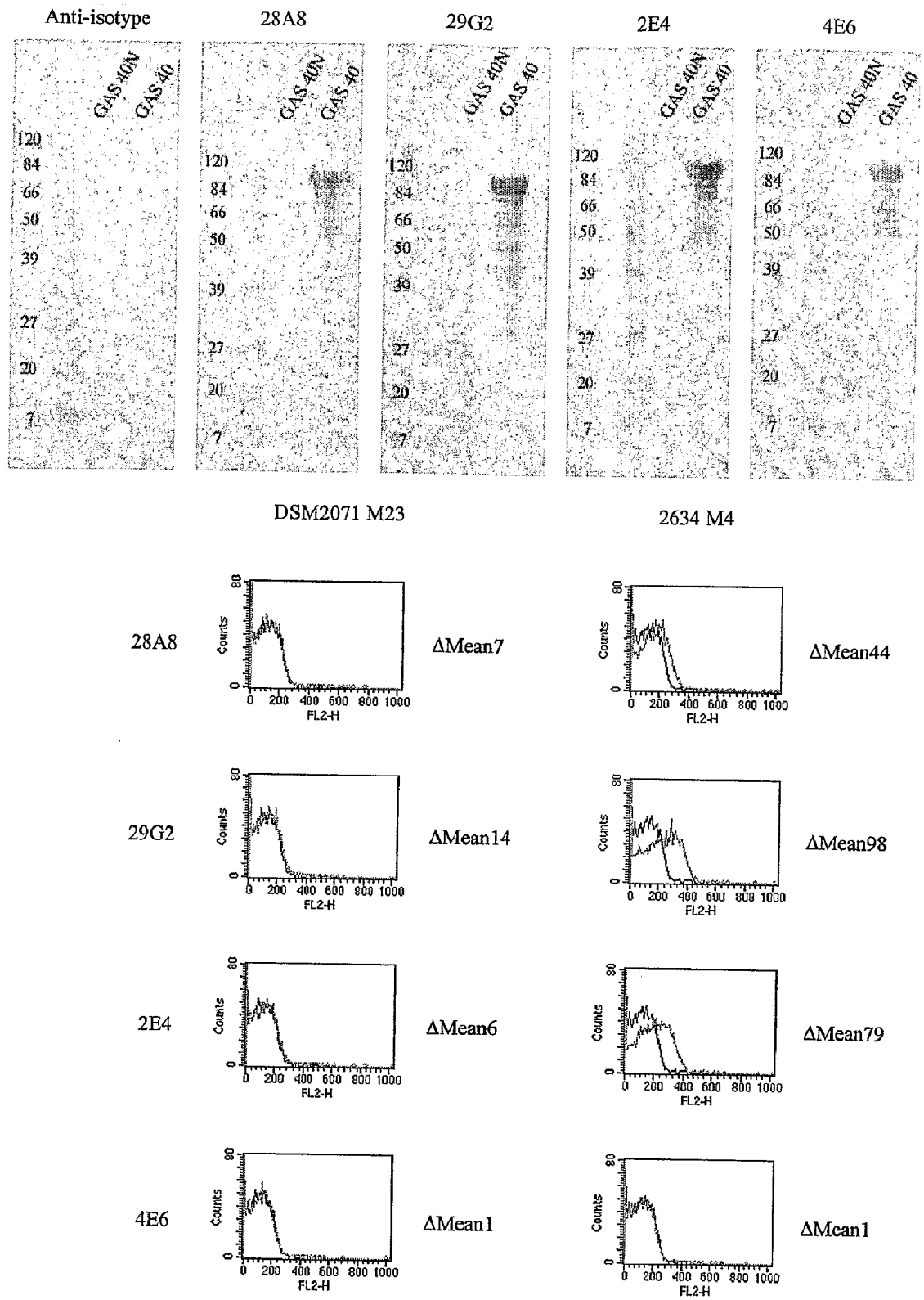
FIG. 24. Western blots and FACS graphs demonstrating that the four monoclonal antibodies tested do not bind to a GAS40N epitope.

FIG. 24 demonstrates that four different monoclonal antibodies against GAS40 (28A8, 29G2, 2E4 and 4E6) do not react with the GAS40N part of the molecule.

Note the blank vertical gel under the heading "GAS40N" and the reactivity with the GAS40 protein (see "GAS40" column). These results indicate that these GAS40 monoclonal antibodies were not raised against a GAS40N-specific epitope.

The FACS graphs shown in FIG. 24 demonstrate that the four GAS40 monoclonal antibodies do not appear to bind to any surface exposed molecules on the M23 strain (no shift in graph peaks), whereas at least three of the four GAS40 monoclonal antibodies appear to bind to surface exposed molecules on the M4 strain. This result may be explained by the fact that the M23 is a capsulated strain and so the capsule is blocking the surface exposed GAS40 molecules.

EXAMPLE 13

Surfome Analysis: Identification of GAS Surface Proteins Using Protease Digestion, Liquid Chromatography, and Tandem Mass Spectromety Bacterial strains and culture. *Streptococcus pyogenes* bacteria from the hypocapsulated M1 wild-type strain SF370 (M1 serotype) (Ferretti et al., Proc. Natl. Acad. Sci. U.S.A. 98, 4658-63, 2001), CDC SS-90 (M3 serotype), and 2071 (M23 serotype) were grown in Todd-Hewiff broth (THB) at 37° C. and 5% $CO_2$, until an $OD_{600}=0.4$ was reached (exponential growth phase). After culture, bacteria were harvested by centrifugation at 3,500×g for 10 minutes at 4° C., washed three times with phosphate-buffered saline (PBS), and used in the experiments described below. Genomic data for M1 are available at the TIGR website (URL address: http file type, www host server, domain name tigr.org), together with bioinformatics prediction results on function.

Bacterial surface digestion. Protease digestion of the bacterial surface was carried out separately with two different enzymes: Sequencing Grade Modified Trypsin (Promega, Madison, Wis.) and proteinase K (Promega). Cells from a 100 ml initial culture were resuspended in 0.8 ml phosphate-based buffer (2.7 mM KCl, 1.5 mM KH2PO4, 13.7 mM NaCl, 8.1 mM Na2HPO4) containing 40% sucrose.

Digestions were carried out in the presence of 5 mM DTT for 30 minutes at 37° C. with either 20 μg trypsin (ph 7.4) or 10 μg proteinase K (pH 6.0). The digestion mixtures were centrifuged at 3,500×g for 10 minutes at 4° C. The supernatants containing the digested peptides were filtered through a Millipore filter with a pore size of 0.22 μm. Protease reactions were stopped by adding 10% v/v of 1% formic acid. Prior to analysis, salts in samples were removed by off-line HPLC, with a 7 min gradient of 2-80% acetonitrile (ACN) in 0.1% formic acid. Fractions collected were pooled and concentrated with a Speed-vac. Supernatants were kept at −20° C. until further analysis.

Multidimensional protein identification technology (MudPIT). Two different platforms were used for the chromatographic separation of peptides and further identification by tandem mass spectrometry (MS/MS).

In the first platform, peptides were separated by two-dimensional nano-liquid chromatography (2-D LC), spotted directly onto a MALDI target, and analyzed by MALDI TOF-TOF (off-line coupled 2-D LC/MALDI MS/MS). The chromatographic system (Dionex, Amsterdam, The Netherlands) consisted of a FAMOS autosampler, an UltiMate micropump with UV detector and a Switchos column-switching device, as described in (Mitulovic et al., Proteomics. 2004 September; 4(9):2545-57). The UltiMate pump was set to operate at a flow rate 300 mL/min. The flow of the Switchos loading pump, which was used to carry the sample from the sample loop to the first column, was set to operate at 30 μL/min.

Briefly, peptide separation was performed as follows. In the first dimension, peptides were loaded on a strong cation exchange (SCX) column (10 cm×320 μm i. d.) and eluted isocratically by applying 5 increasing NaCl concentrations (0.01, 0.05, 0.1, 0.5 and 1 M). In the second dimension, peptides were separated by a reversed phase C18 analytical column (15 cm×75 μm i. d., C18 PEPMAP100™, 3 μm, 100 Å) through a C18 trap column (PEPMAP™ C18 μ-precolumn, 300 μm i.d.×1 mm, Dionex). Peptides were eluted with a 45-min gradient from 5 to 50% of 80% ACN in 0.1% formic acid at a flow rate of 300 nl/min.

Eluates were continuously spotted onto an ANCHORCHIP® MALDI target (Bruker Daltoniks, Bremen, Germany) every 60 s using a Proteineer FC robot (Bruker Daltoniks) prepared with a thin layer of a saturated solution of α-cyano-4-hydroxycynnamic acid in acetone, every 60 s using a Proteineer FC robot (Bruker Daltoniks). Prior to spotting, the target was prepared with a thin layer of a saturated solution of α-cyano-4-hydroxycynnamic acid in acetone. After fraction collection, every spot was manually recrystallized with 0.6 μl of ethanol/acetone/0.1% trifluoroacetic acid (6:3:1).

Mass spectrometry analysis was performed automatically with an Ultraflex MALDI TOF-TOF instrument, under the control of the WARP LC software (Bruker Daltoniks). First, MS spectra of all the spotted fractions were acquired for peak selection and further MS/MS spectra acquisition of selected peaks. Searching and identification of peptides were performed in batch mode with a licensed version of MASCOT in a local database. The MASCOT search parameters were: (1) species: *S. pyogenes* strain SF370; (2) allowed number of missed cleavages (only for trypsin digestion): 6; (3) variable post-translational modifications: methionine oxidation; (4) peptide tolerance: ±300 ppm; (5) MS/MS tolerance: ±1.5 Da and (6): peptide charge: +1.

In the second platform, peptides were separated by nanoLC-MS/MS on a CapLC HPLC system (Waters, Milford, Mass., USA) connected to a Q-ToF Micro ESI mass spectrometer equipped with a nanospray source (Waters, Milford, Mass., USA). Samples were resuspended in 5% (v/v) ACN, 0.1% (v/v) formic acid (Solvent A) and loaded on a C18 trap column (300 μm i.d.×5 mm, LC Packings, Amsterdam, The Netherlands). After 3 min, the flow was switched to an Atlantis C18 NanoEase column (100 μm i.d.×100 mm, Waters, Milford, Mass., USA) and a solvent gradient was started. The applied flow rate was of 4 μL/min and a flow splitter was set up to direct a nanoflow of 400 mL/min through the analytical column.

Peptides were eluted applying a linear gradient in 50 min from 2% to 60% Solvent B (95% (v/v) ACN, 0.1% (v/v) formic acid). The eluted peptides were subjected to an automated data-dependent acquisition program, using the MassLynx software (Waters, Milford, Mass., USA), where a MS survey scan was used to automatically select multi-charged peptides to be subjected to MS/MS fragmentation. Up to three different components where subjected to MS/MS fragmentation at the same time. For all the samples a second nanoLC-MS/MS analysis was carried out for the selective fragmentation of mono-charged peptide species.

All the acquired MS/MS spectra were converted in PKL file format and protein identification was achieved by database searching using licensed version of MASCOT running on local database. The applied searching criteria were the following: peptide tolerance ±500 ppm, MS/MS tolerance ±0.3Da, missed cleavage 6, peptide charge states from 1+ to 4+.

Cloning, expression and purification of recombinant proteins, and preparation of preimmune and immune sera, was done as described in Maione et al., Science 309, 148-50, 2005.

FACS analysis. FACS analysis was performed as follows. About 105 bacteria were washed with 200 μl of PBS, centrifuged for 10 minutes at 3,500×g, at 4° C., and then resuspended in 20 μl of PBS-0.1% BSA. Eighty μl of either preimmune or immune mouse serum diluted in PBS-0.1% BSA were added to the bacterial suspension to a final dilution of either 1:100, 1:250, or 1:500, and incubated on ice for 30 min.

Bacteria were washed once by adding 100 μl of PBS-0.1% BSA, centrifuged for 10 minutes at 3,500×g, at 4° C., resuspended in 200 μl of PBS-0.1% BSA, and centrifuged again. The bacteria were resuspended in 10 μl of phycoerythrin-conjugated goat anti-mouse IgG F(ab')₂ fragment (Jackson Immunoresearch Laboratories Inc.) in PBS-0.1% BSA to a final dilution of 1:100, and incubated on ice for 30 minutes in the dark.

Bacteria were then washed by adding 180 μl of PBS-0.1% BSA, and centrifuged for 10 minutes at 3,500×g, at 4° C., and resuspended in 200 μl of PBS.

The bacterial resuspension was then analyzed using a FACS Calibur instrument (Becton Dickinson, Mountain View, Calif. USA), and 10,000 events were acquired. Data were analyzed using Cell Quest Software (Becton Dickinson) by drawing a morphological dot plot (using forward and side scatter parameters) on bacterial signals. A histogram plot was then created on FL2 intensity of fluorescence log scale.

EXAMPLE 14

Surfome of SF370 (M1 Serotype)

The approach described above unambiguously identified 72 proteins from a total of 177 tryptic peptides and 107 peptides generated by proteinase K digestion. Ten proteins were identified from proteinase K-derived peptides, and 19 proteins were identified from both trypsin and proteinase K peptides. Table 9 shows the list of the proteins identified by applying both LC/MS/MS platforms, based on ESI-q-TOF and MALDI-TOF/TOF technologies. The protein list is the result of joining data from three independent surface digestion experiments for each protease. At least two chromatographic runs, followed by MS/MS analysis, were performed per sample and platform. Approximately 5 pmol of peptides were loaded into both 2-D LC/MALDI MS/MS and LC/ESI MS/MS systems. Assignment of subcellular location and specific protein features was made by means of PSORT software.

By scanning the sequence of each identified protein for the presence of signatures indicative of specific cellular localization, the 72 proteins could be grouped into 4 major families: the cell wall-anchored protein family containing LPXTG (SEQ ID NO:931)-like motifs (12 proteins), the lipoprotein family (11 proteins), the transmembrane protein family carrying one or more transmembrane spanning regions (37 proteins) and the family of secreted proteins (8 proteins). Based on genome computer analysis, the total number of GAS SF370 proteins which could be attributed to each of these protein families are 17, 28, 489 and 67, respectively. Therefore, while a large proportion of all predicted cell-wall anchored proteins and lipoproteins were identified, less than 7% of secreted proteins and membrane spanning proteins were found exposed on the cell surface.

This discrepancy was expected for the secreted proteins, being consistent with the notion that most of them are released out of the cell and only a fraction remain partially associated to the cell wall. On the contrary, the small number of identified transmembrane proteins was somehow surprising and suggested that a large fraction of these proteins are either deeply embedded in the membrane, or poorly expressed or both. Interestingly, only 4 PSORT-predicted cytoplasmic proteins were found associated to the external side of the cell (Table 9), and all of them belong to the category of cytoplasmic proteins reported to be membrane-associated in most, if not all, bacteria so far analyzed. They included the elongation factor Tu, reported to be membrane-associated in other bacteria (Marques et al., Infect. Immun. 66, 2625-31, 1998; Dallo et al., Mol. Microbiol. 46, 1041-51, 2002), two ribosomal proteins (Spence & Clark, Infect. Immun. 68, 5002-10, 2000; Kurar & Splitter, Vaccine 15, 1851-57, 1997), and a hypothetical protein possibly involved in cell wall localization and side chain formation.

Figure 28:
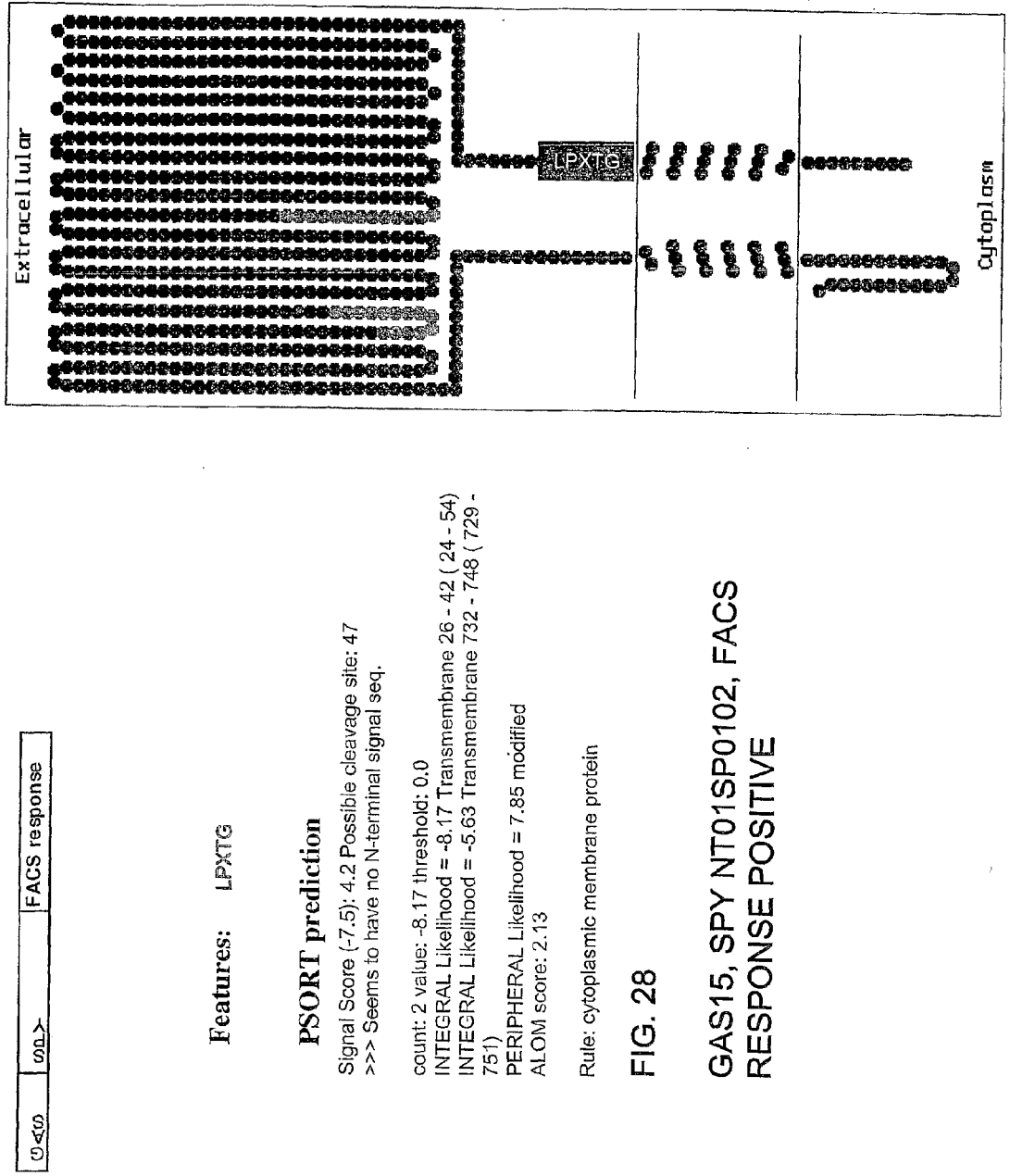
FIG. 28-104. Topological representations of identified membrane-associated proteins. The protease cleavage sites are in red. LPXTG, SEQ ID NO:931.
Figure 29:
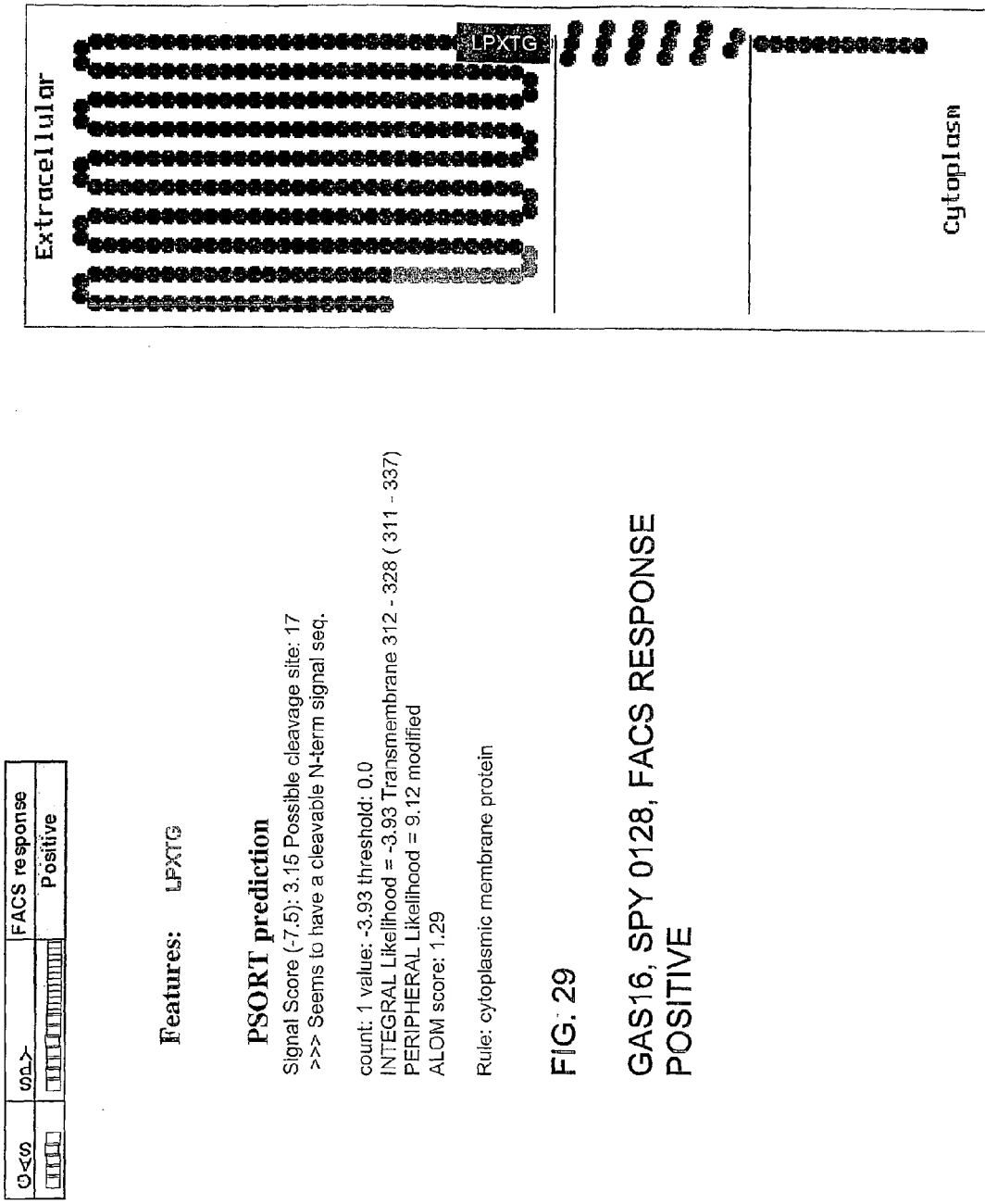
Figure 30:
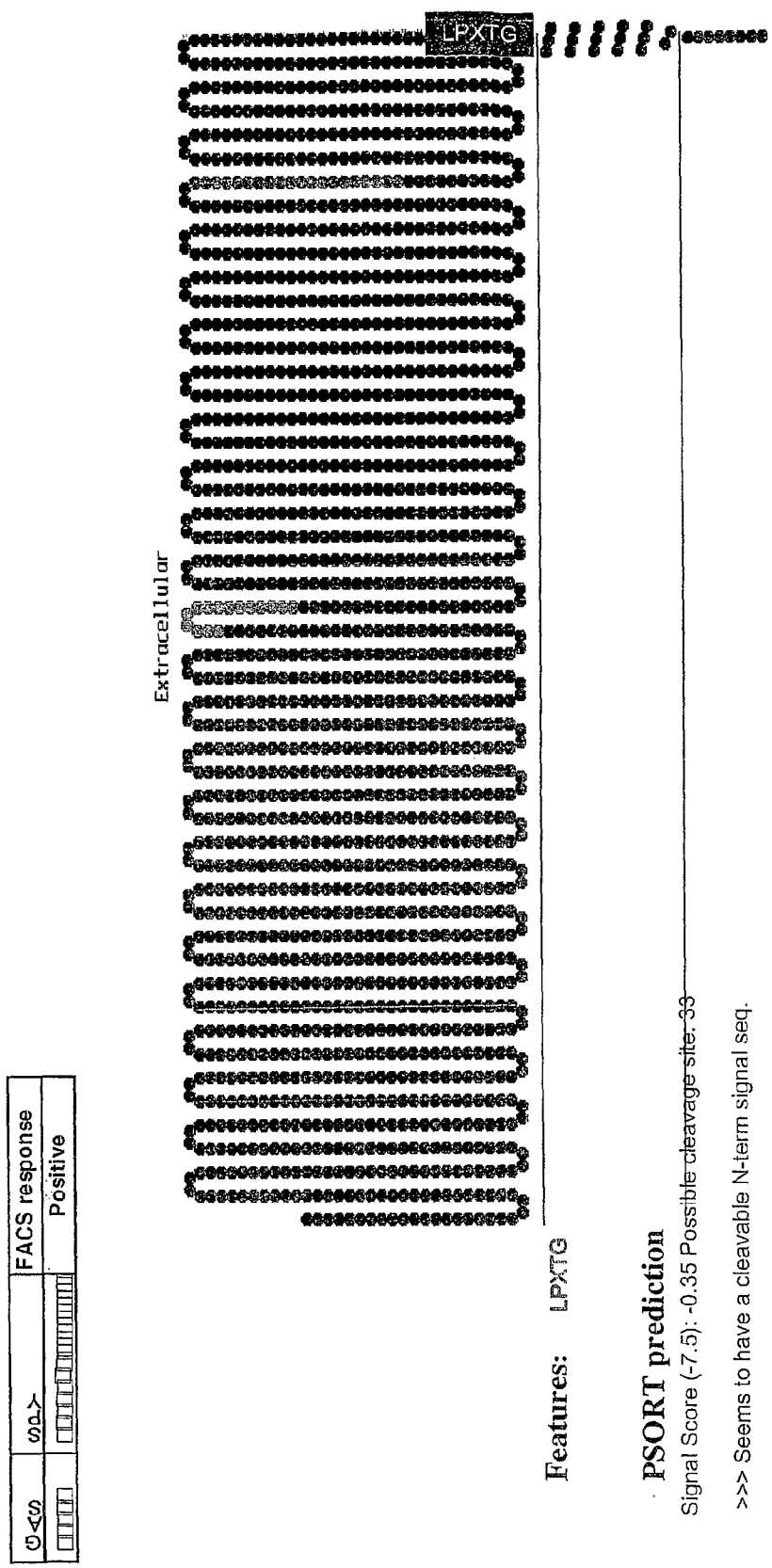
Figure 31:
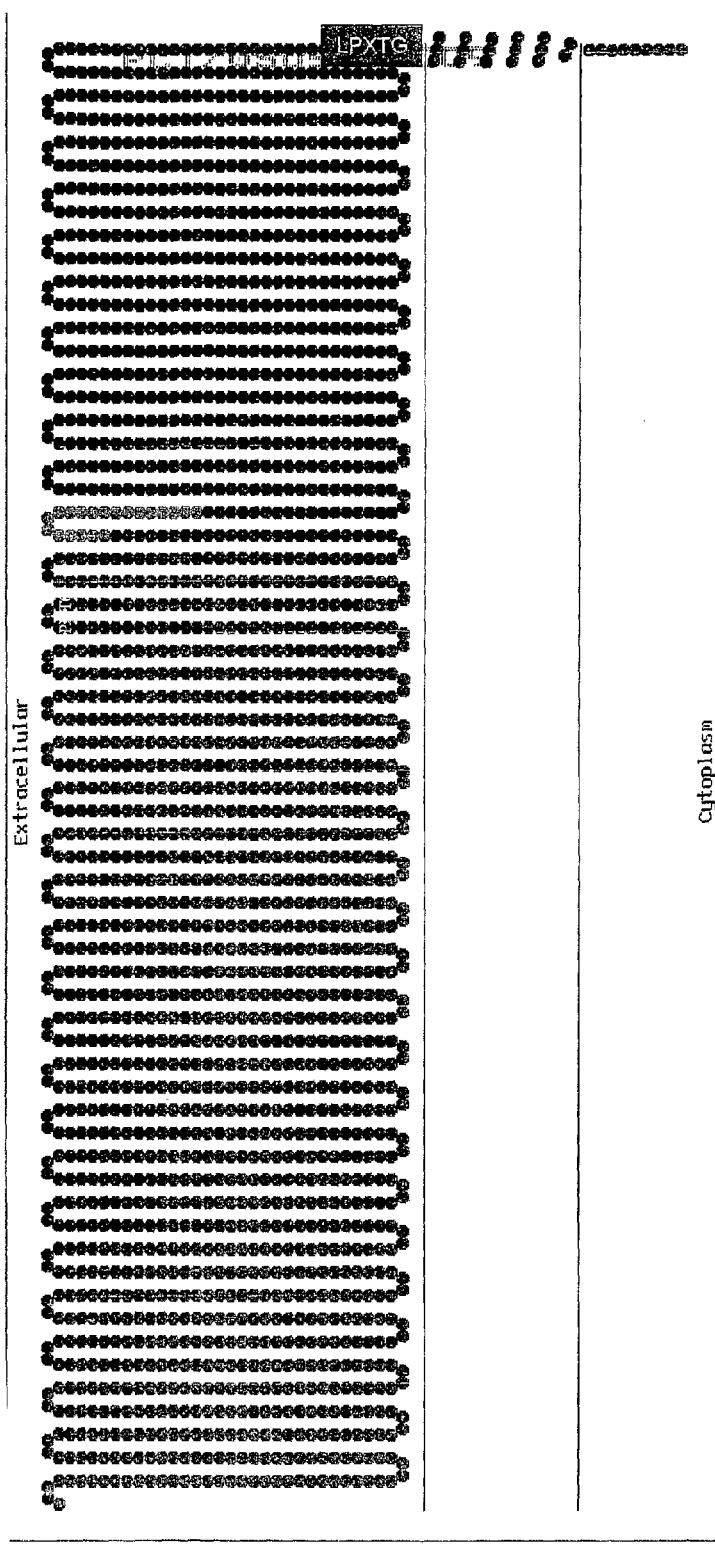
Figure 32:
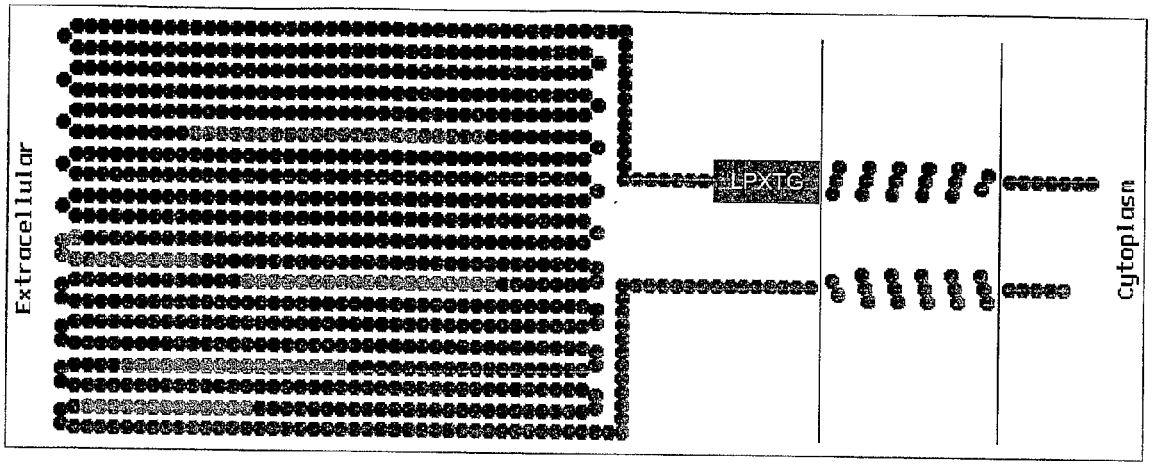
Figure 33:
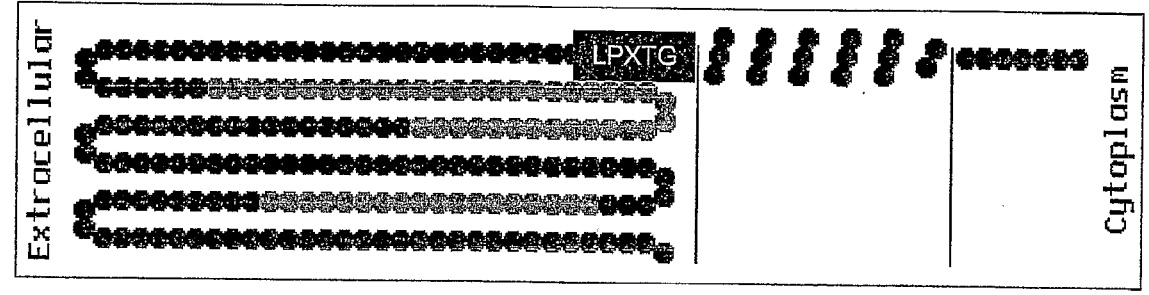
Figure 34:
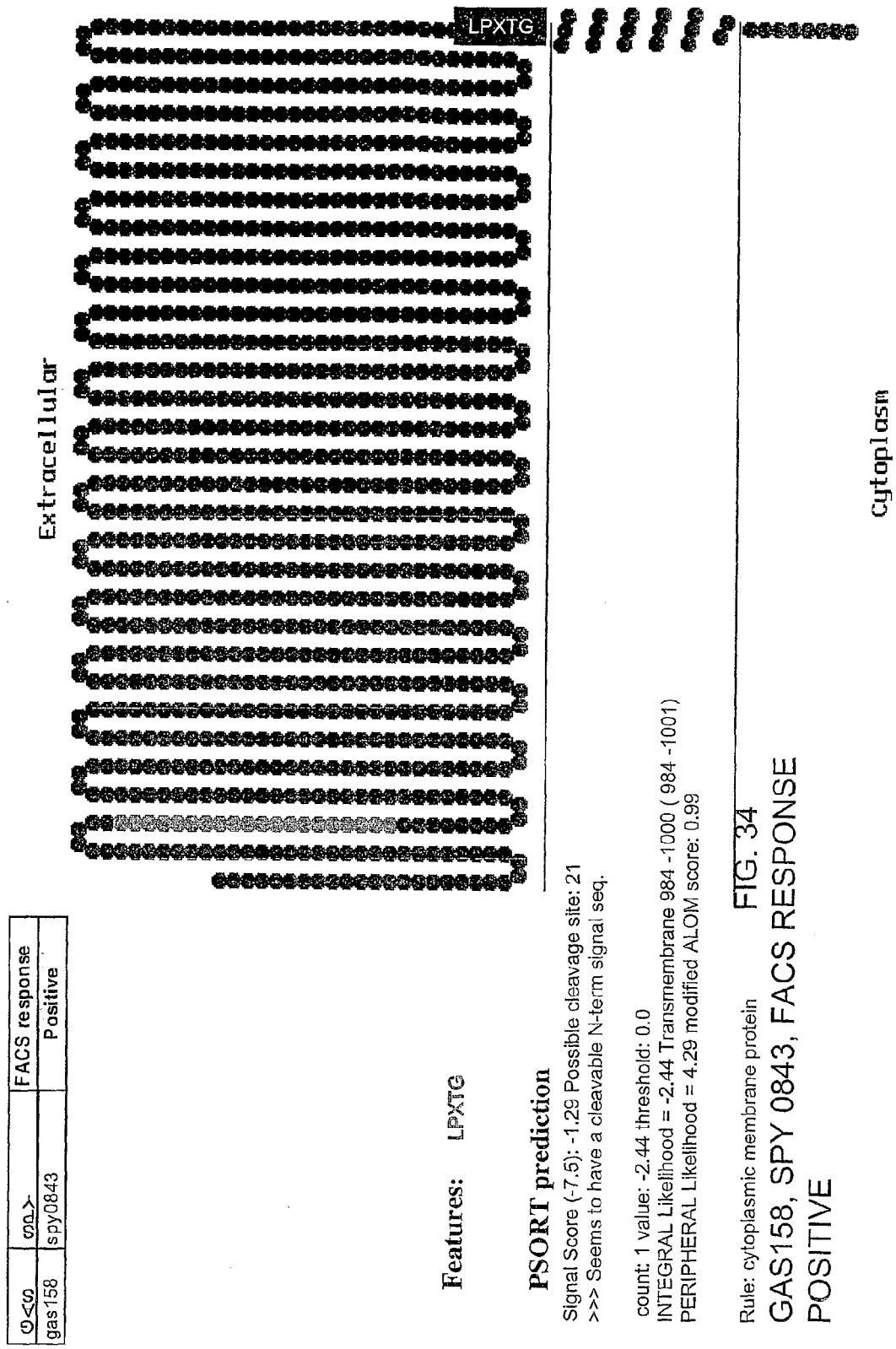
Figure 35:
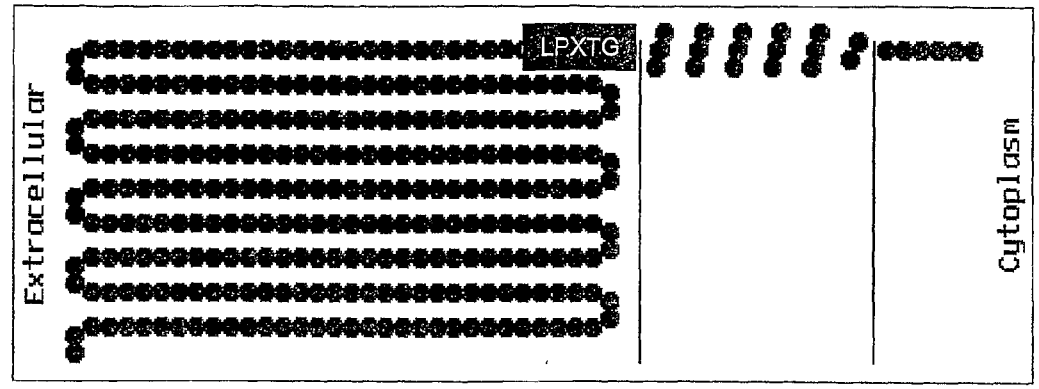
Figure 36:
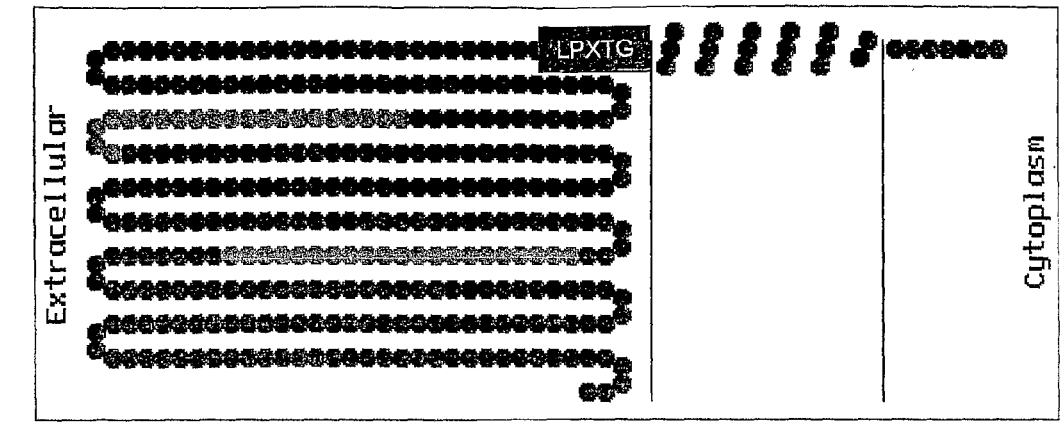
Figure 37:
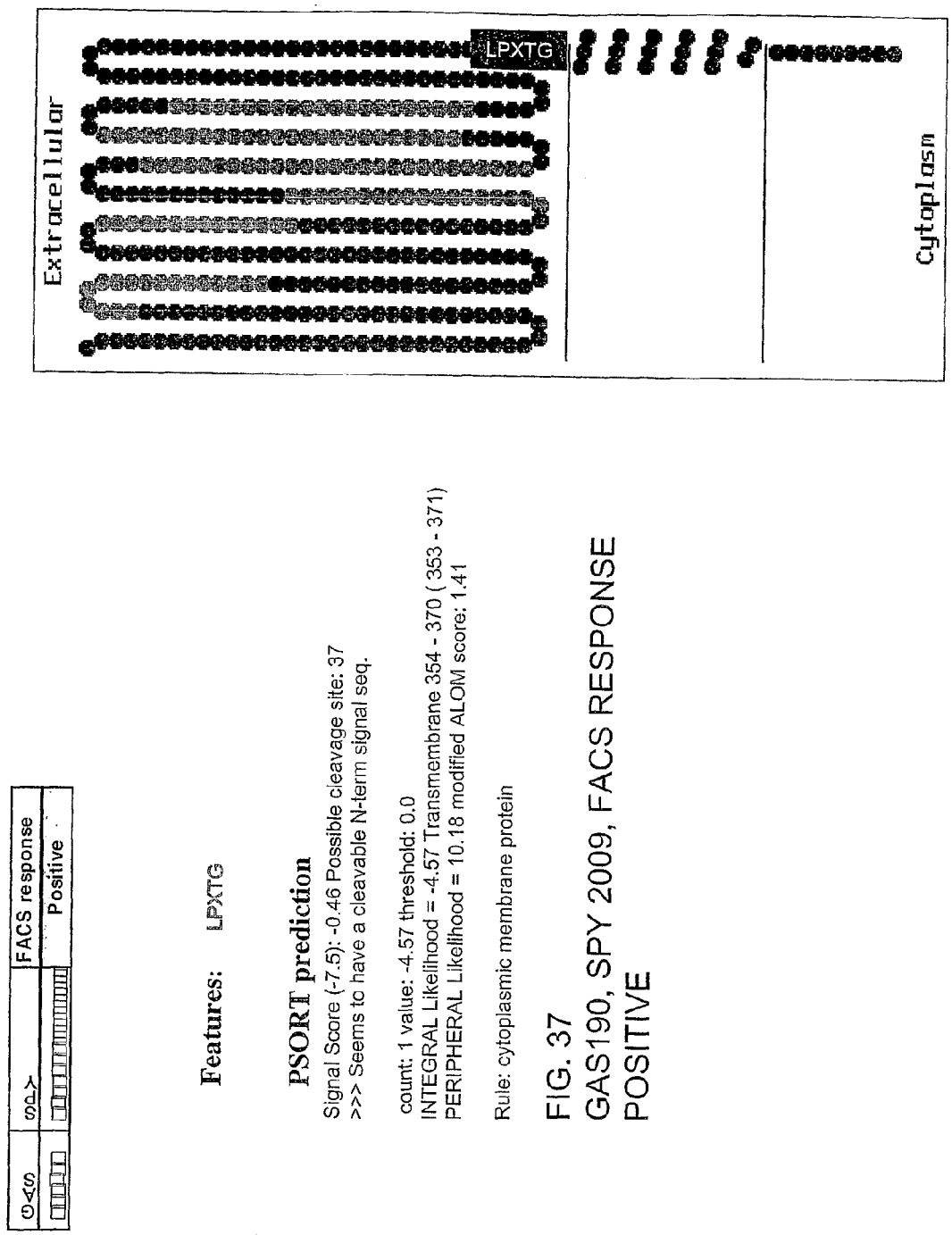
Figure 38:
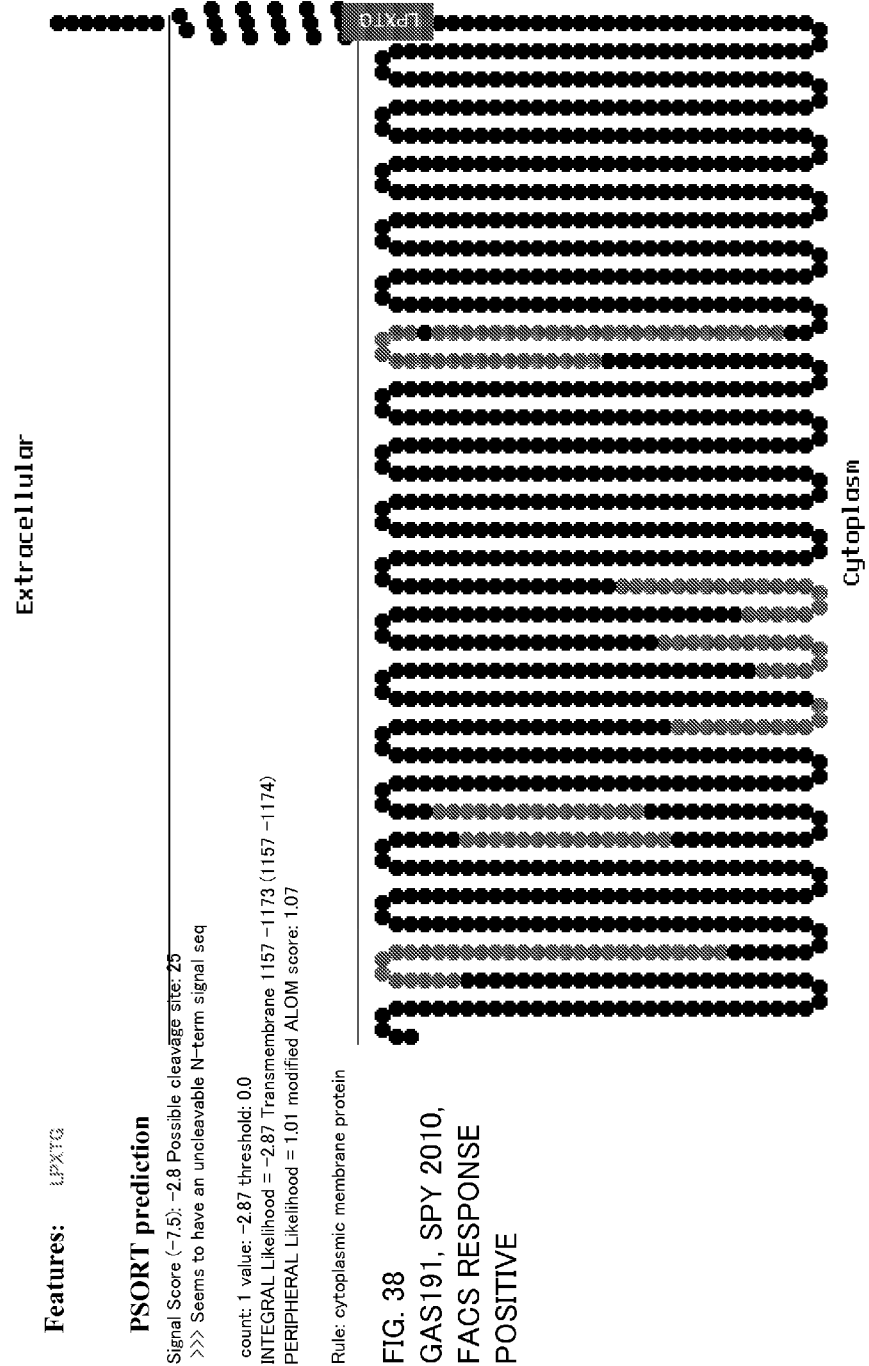
Figure 39:
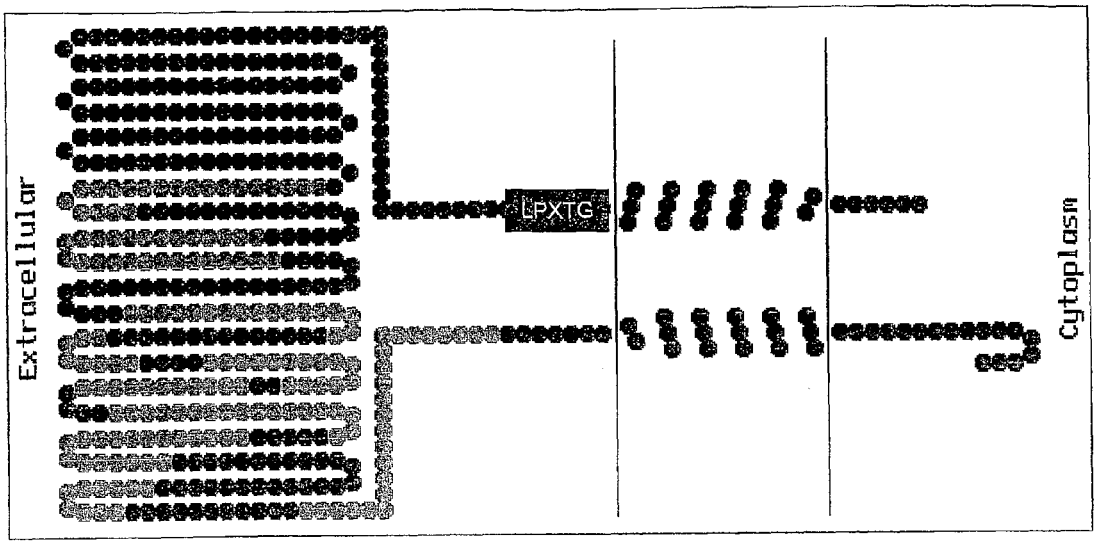
Figure 40:
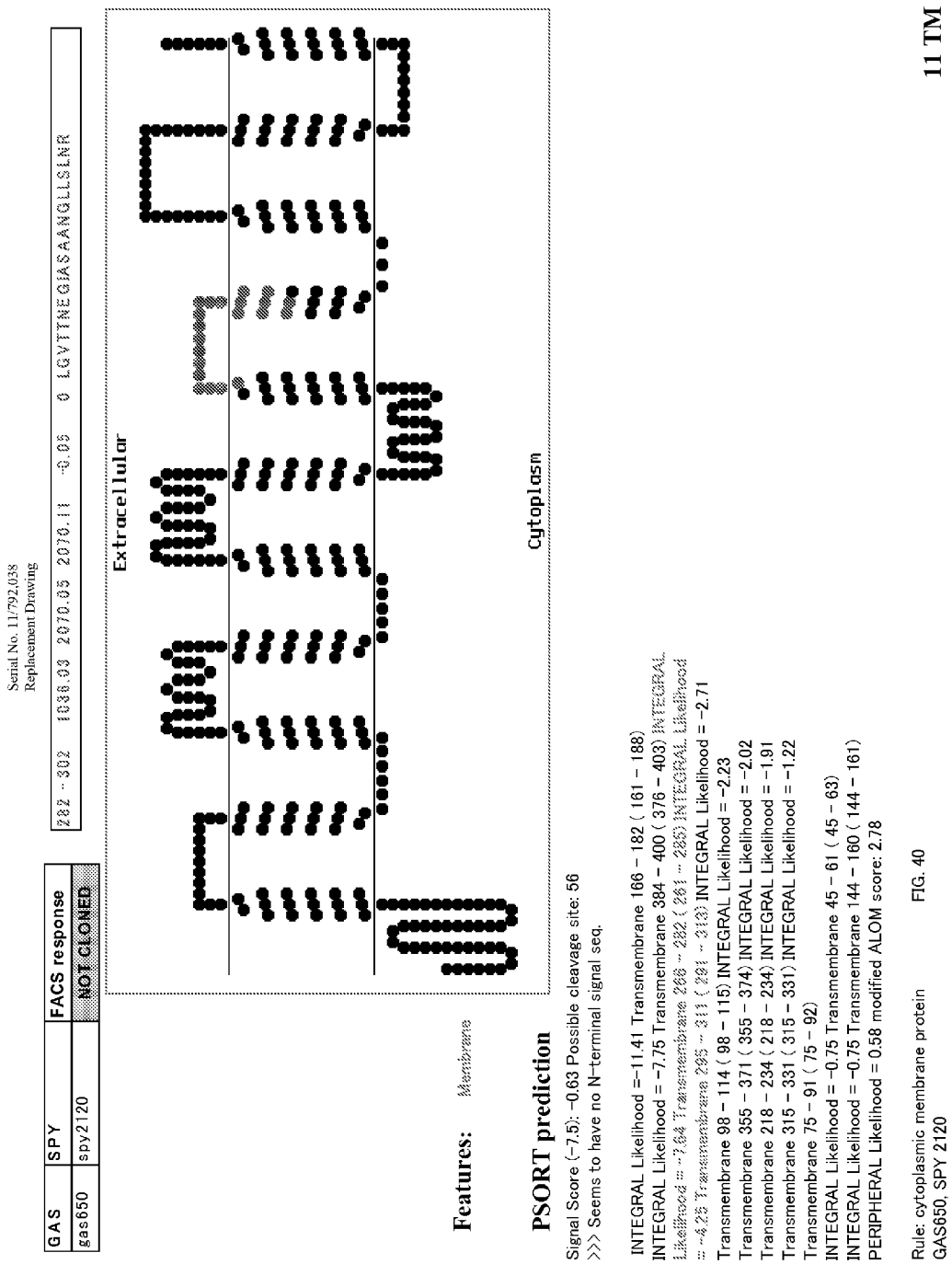
Figure 43:
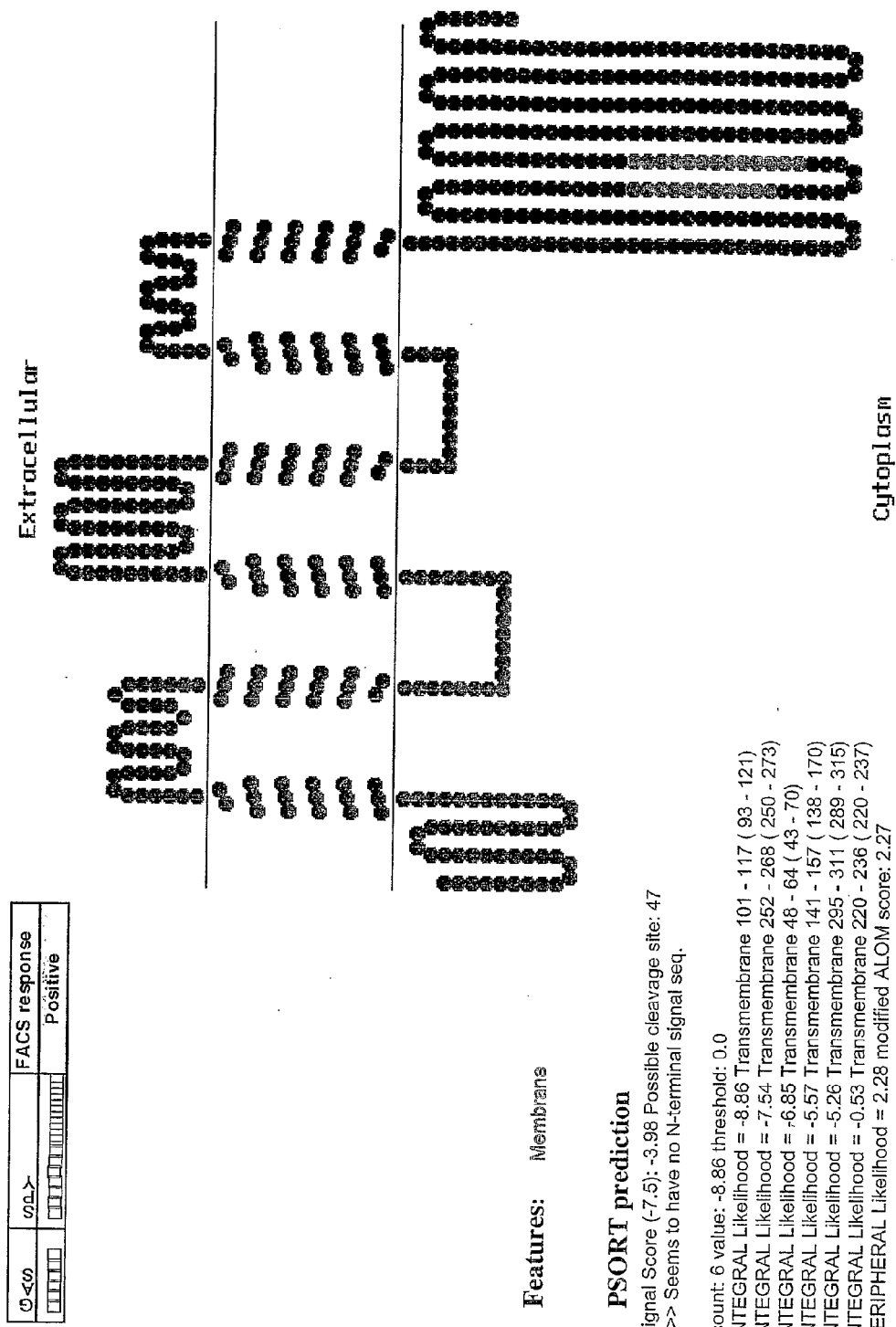
Figure 51:
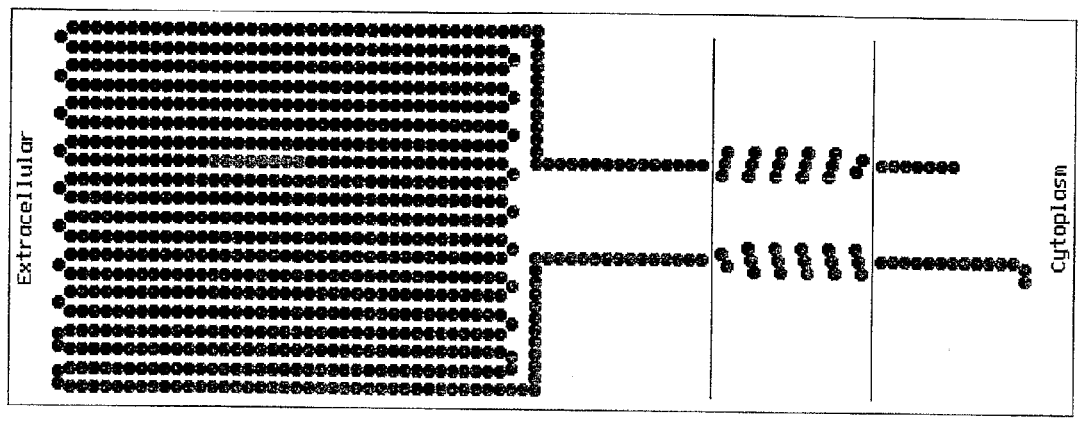
Figure 52:
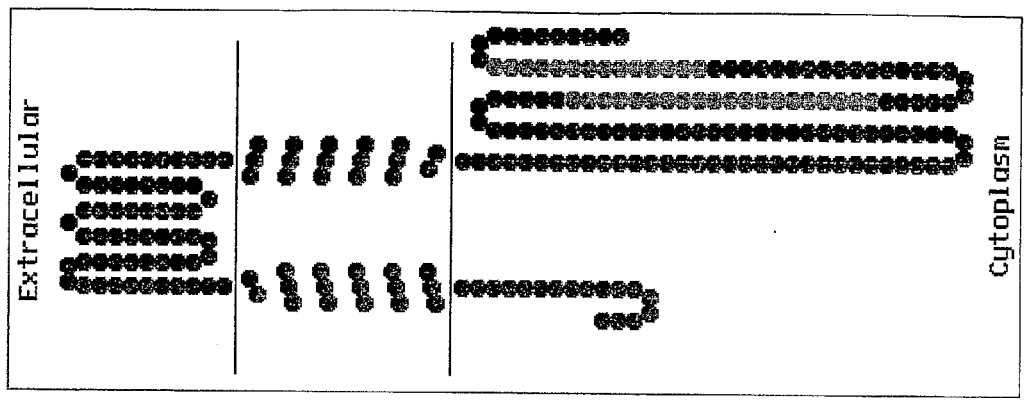
Figure 53:
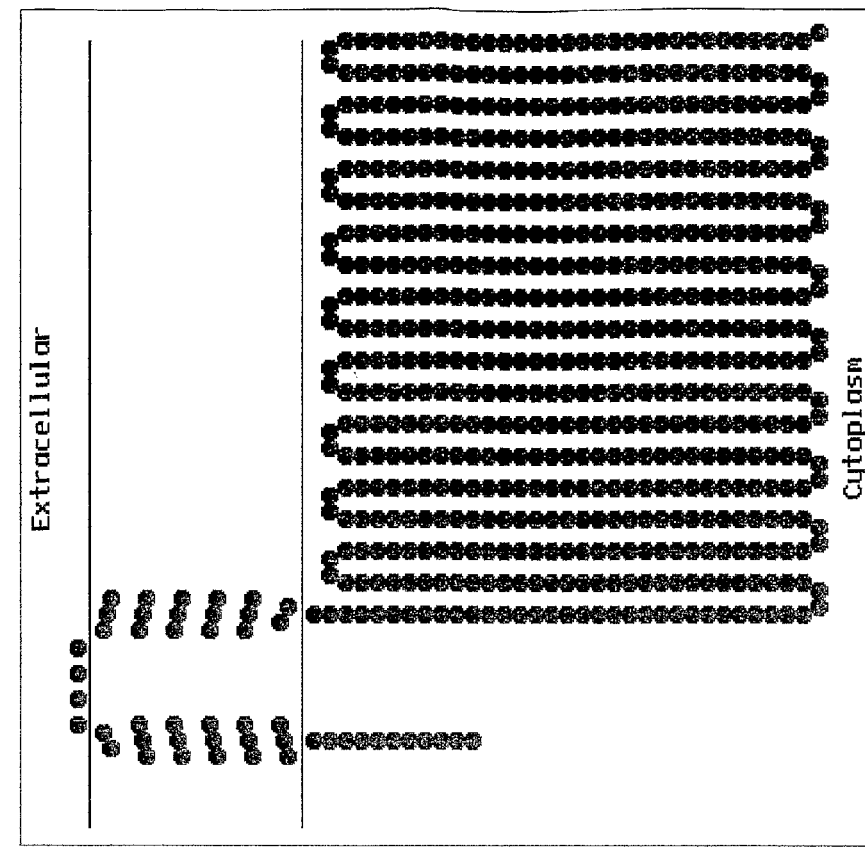
Figure 54:
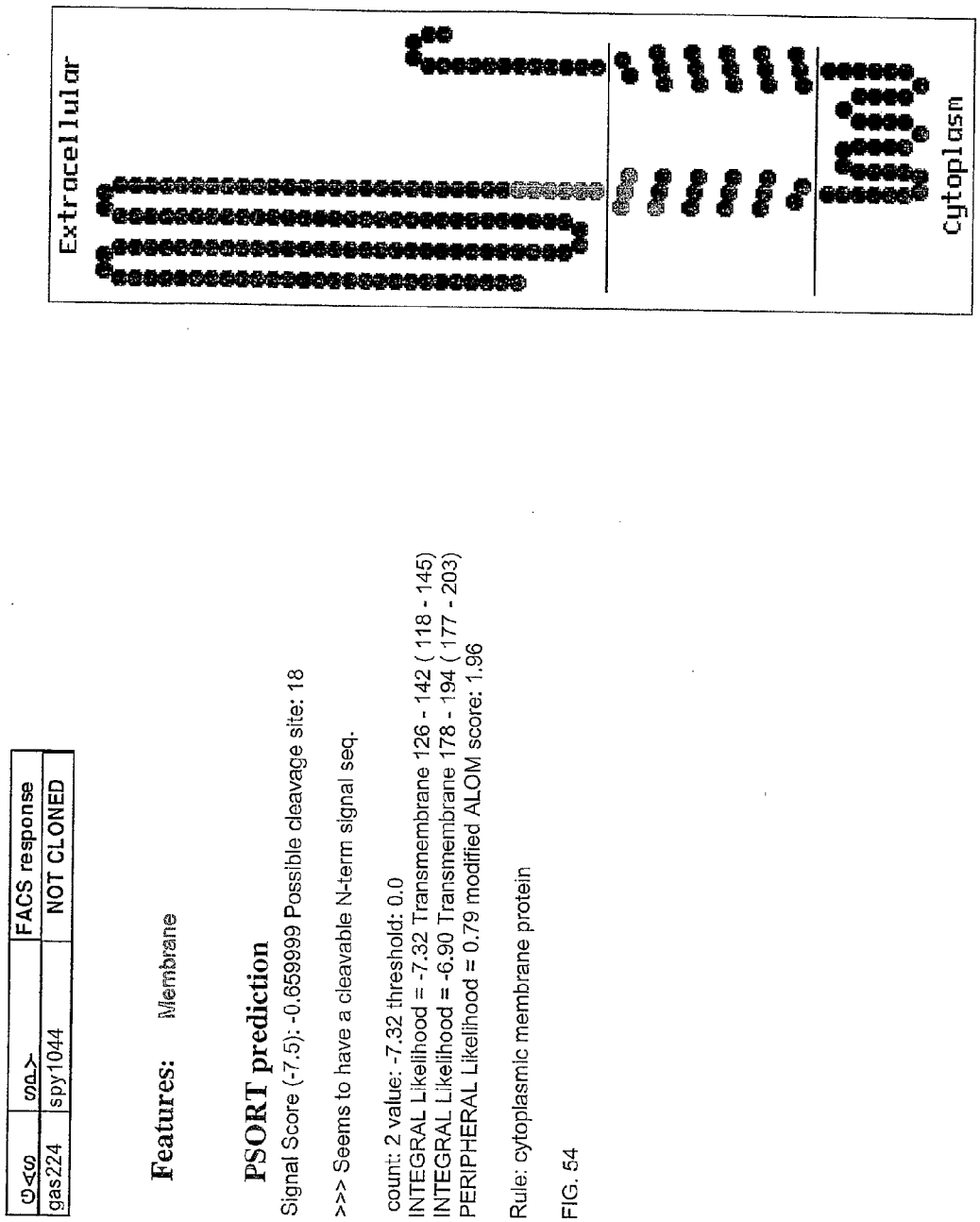
Figure 55:
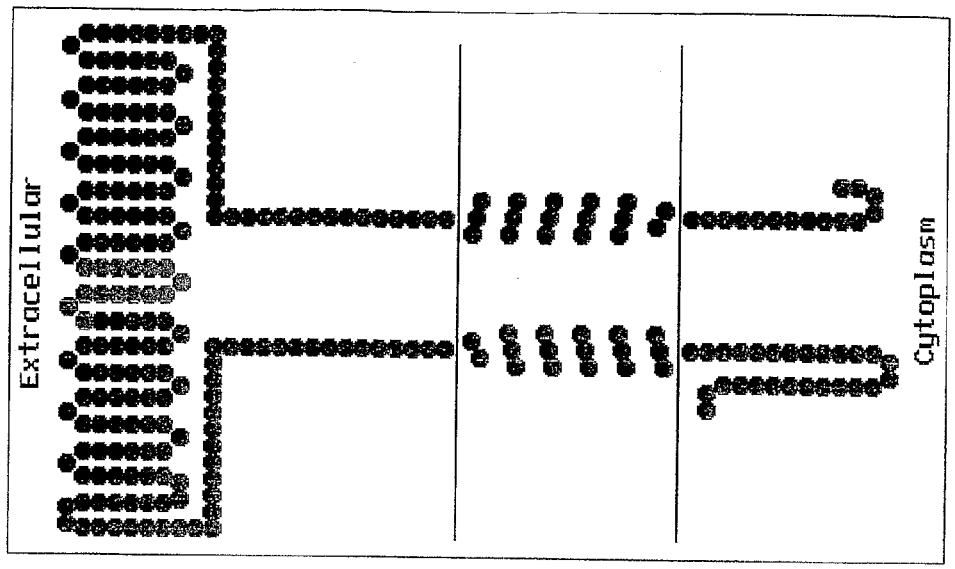
Figure 56:
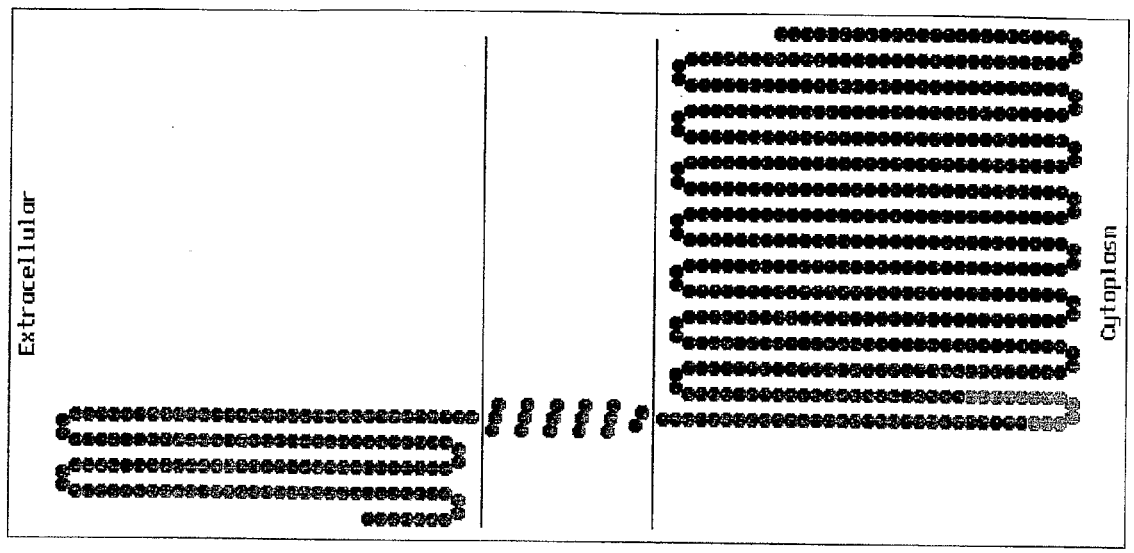
Figure 57:
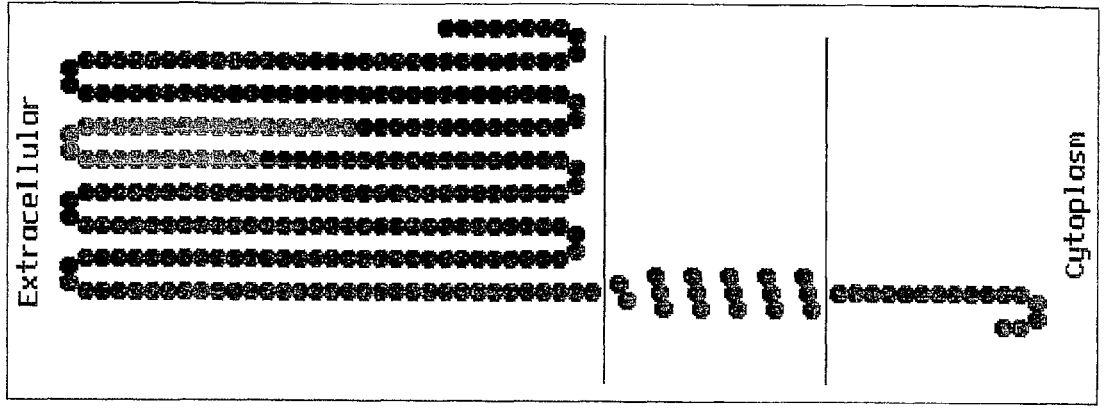
Figure 58:
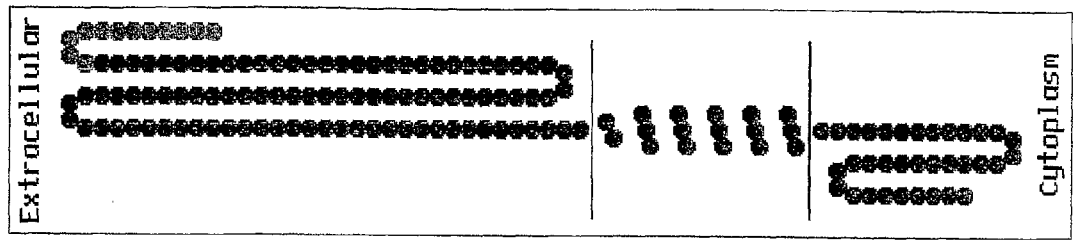
Figure 59:
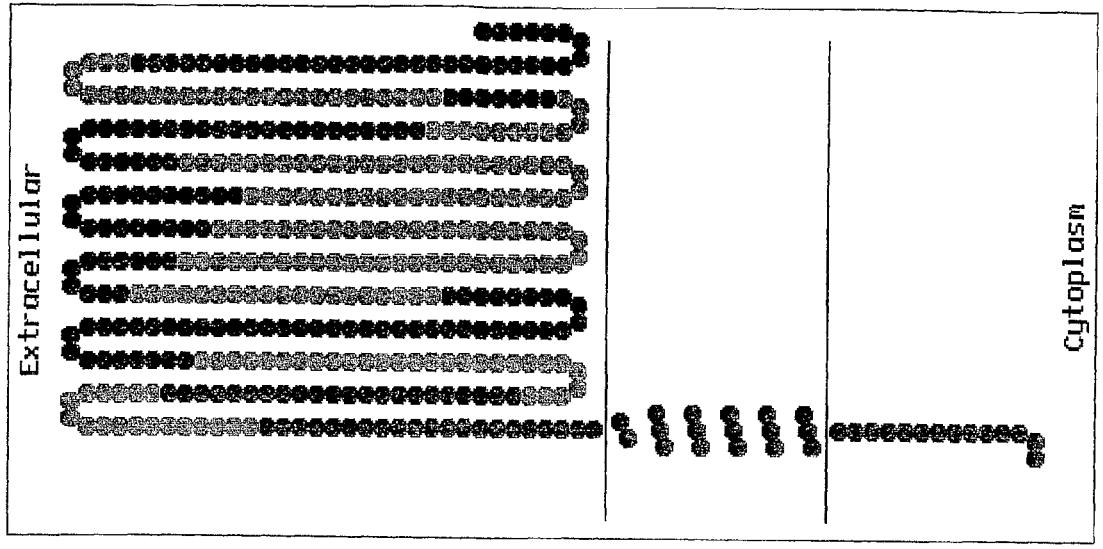
Figure 69:
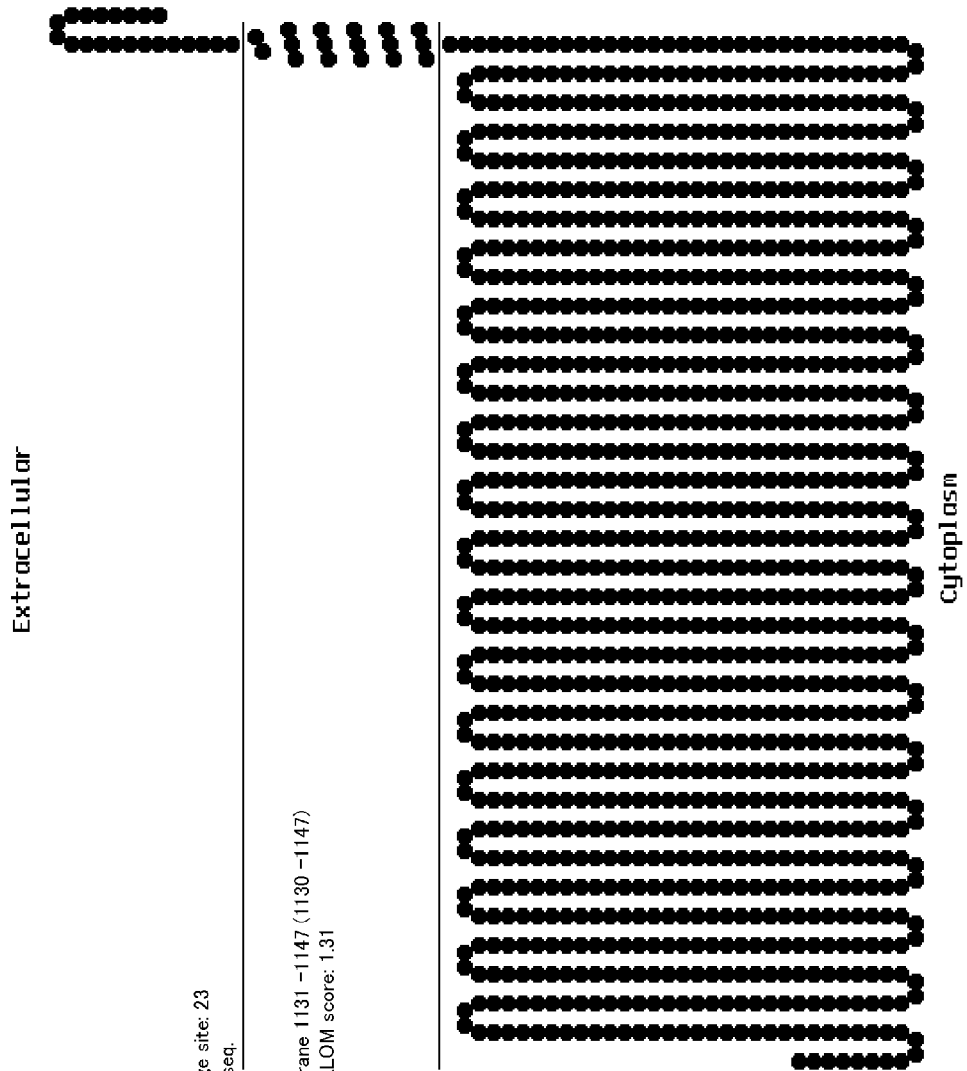
Figure 61:
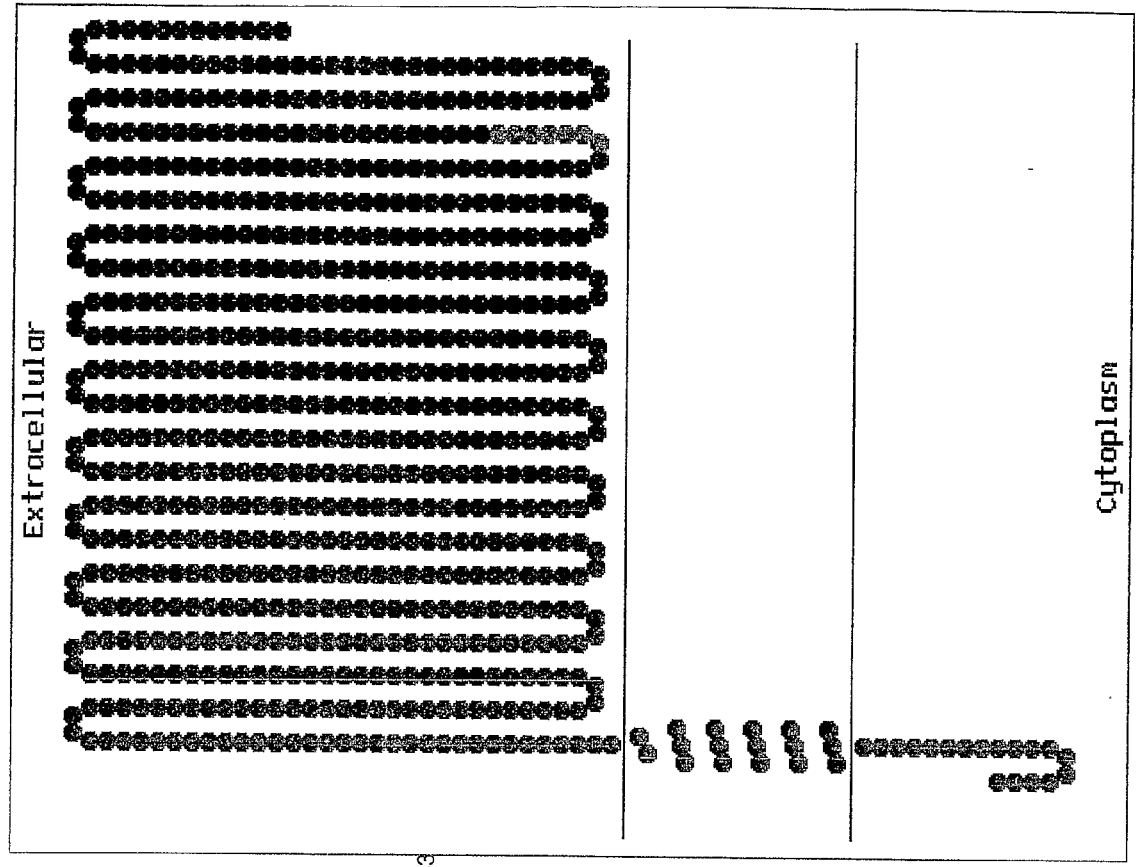
Figure 62:
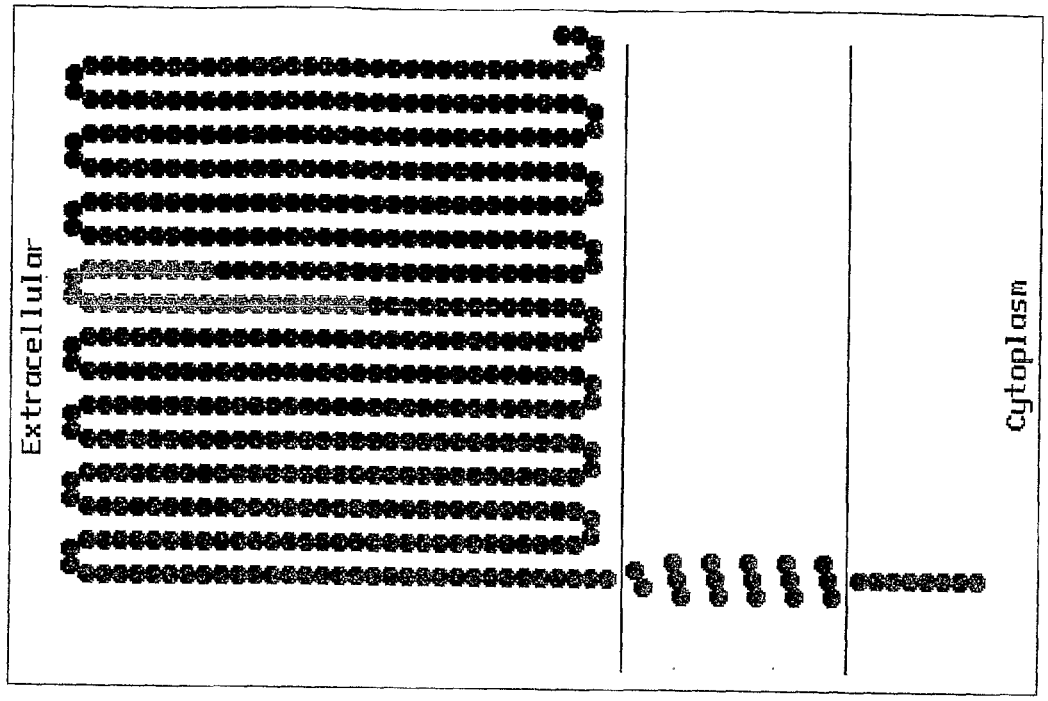
Figure 63:
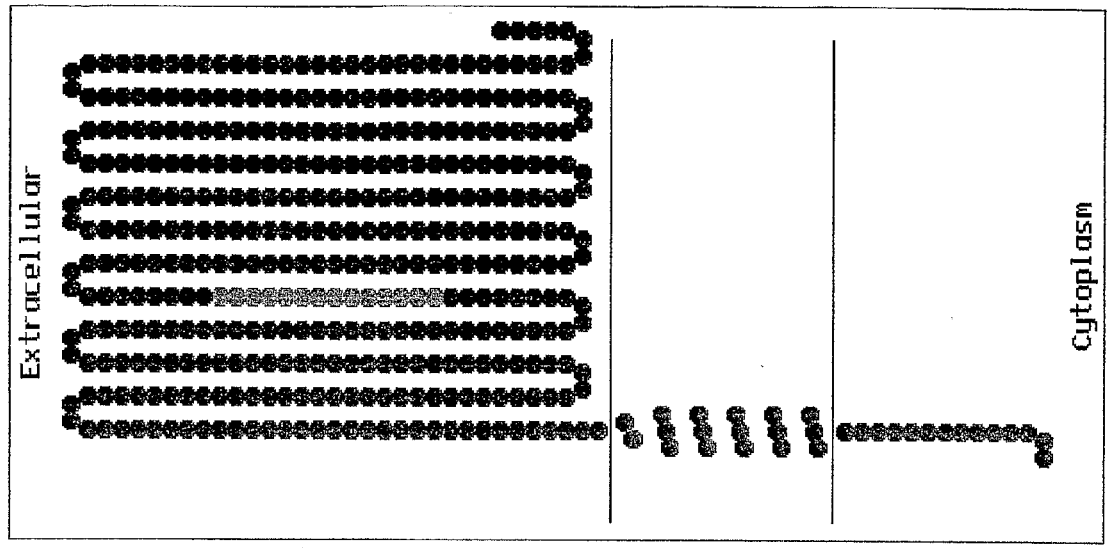
Figure 64:
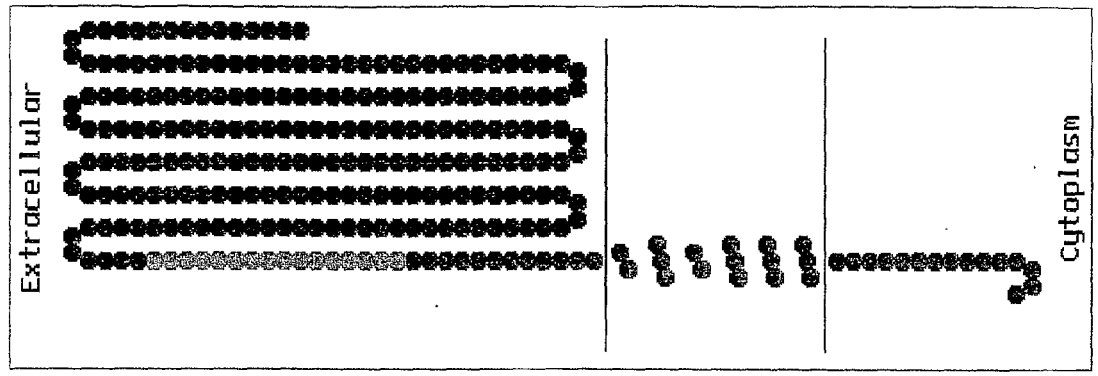
Figure 65:
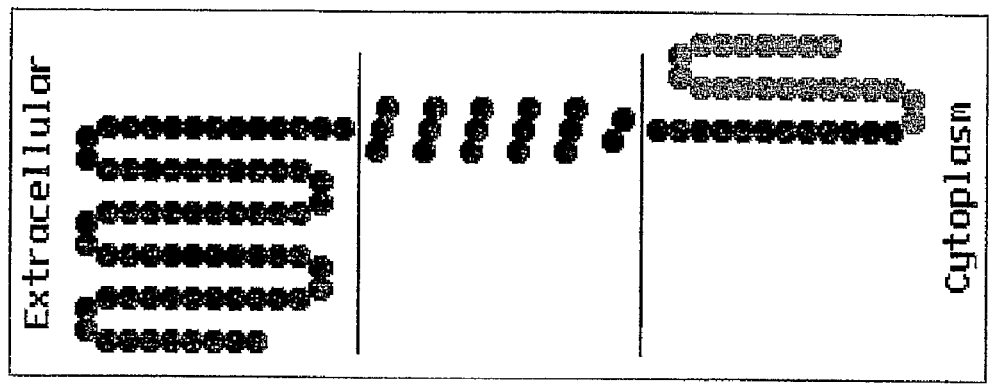
Figure 66:
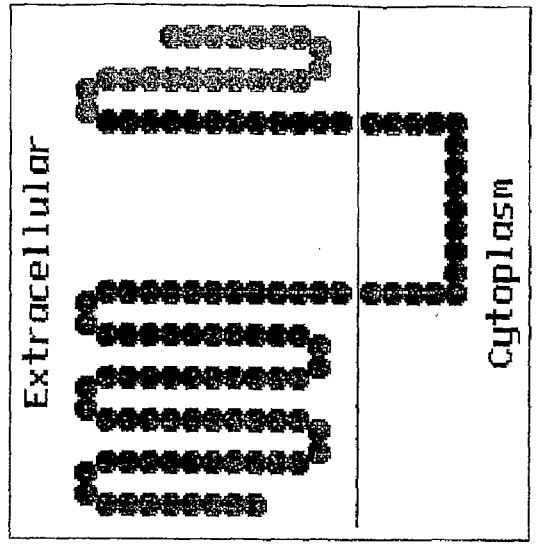
Figure 67:
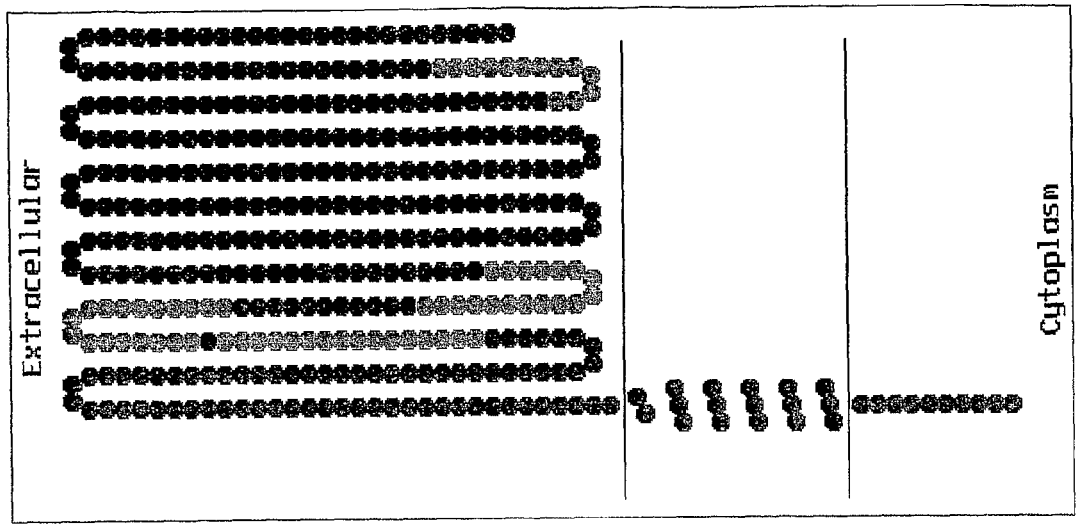
Figure 68:
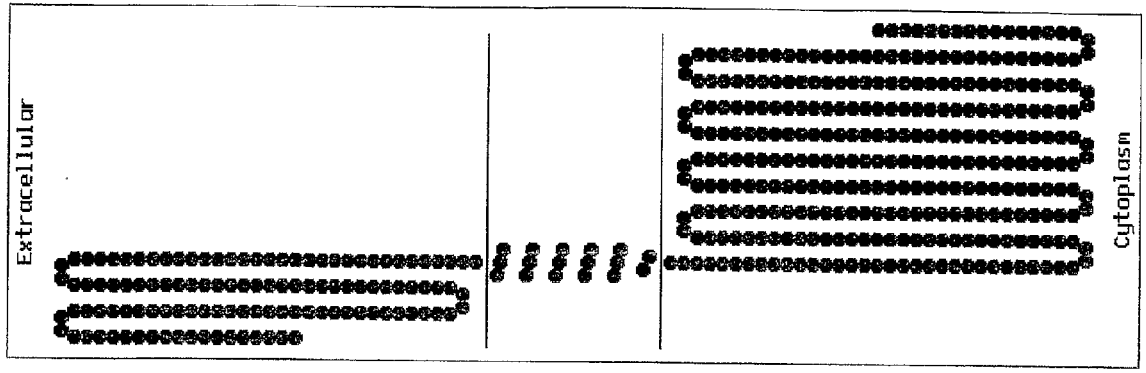
Figure 69:
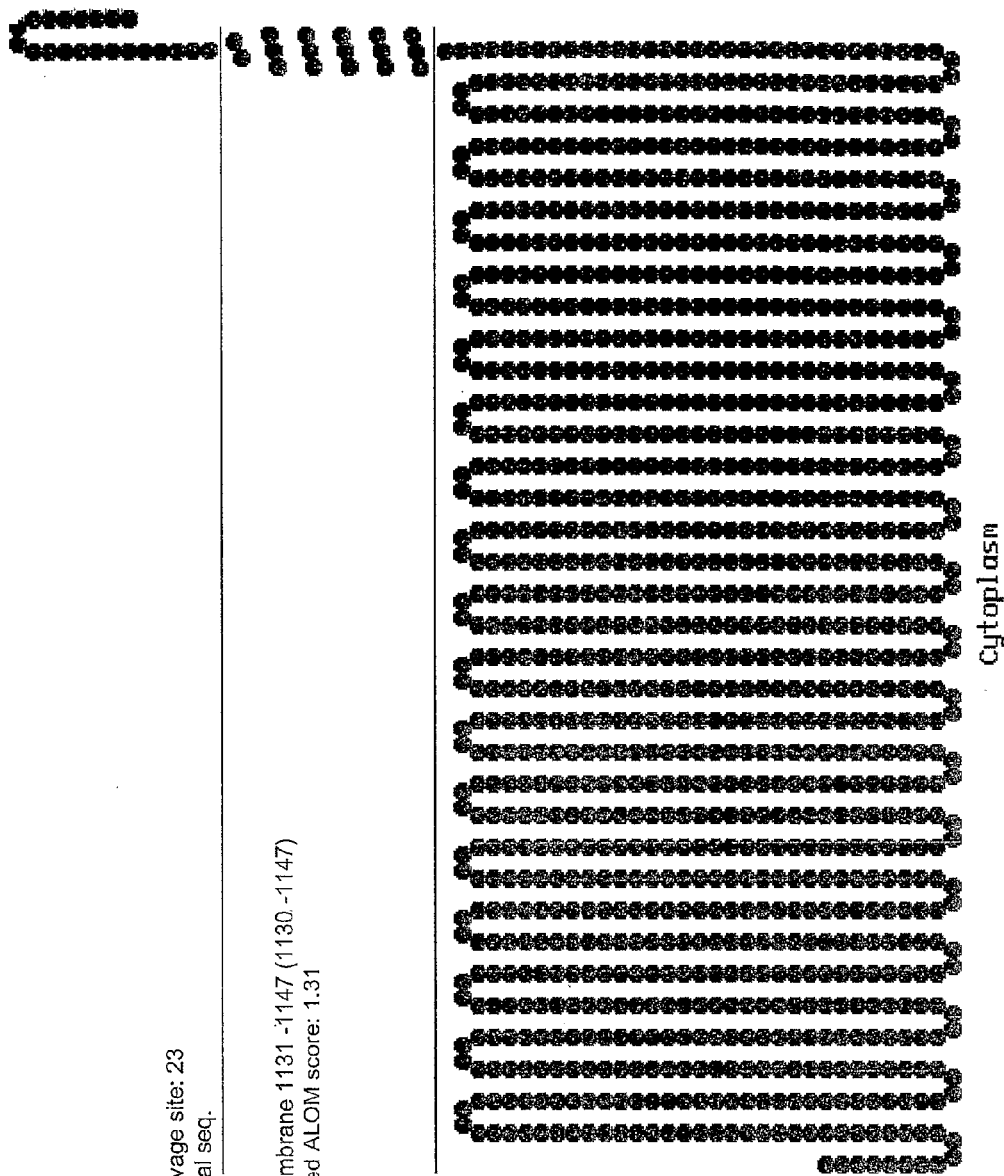
Figure 70:
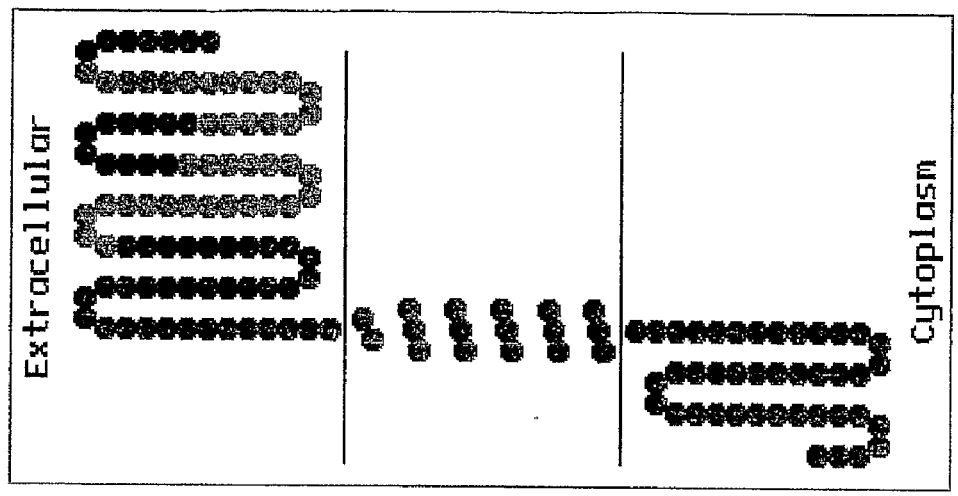
Figure 71:
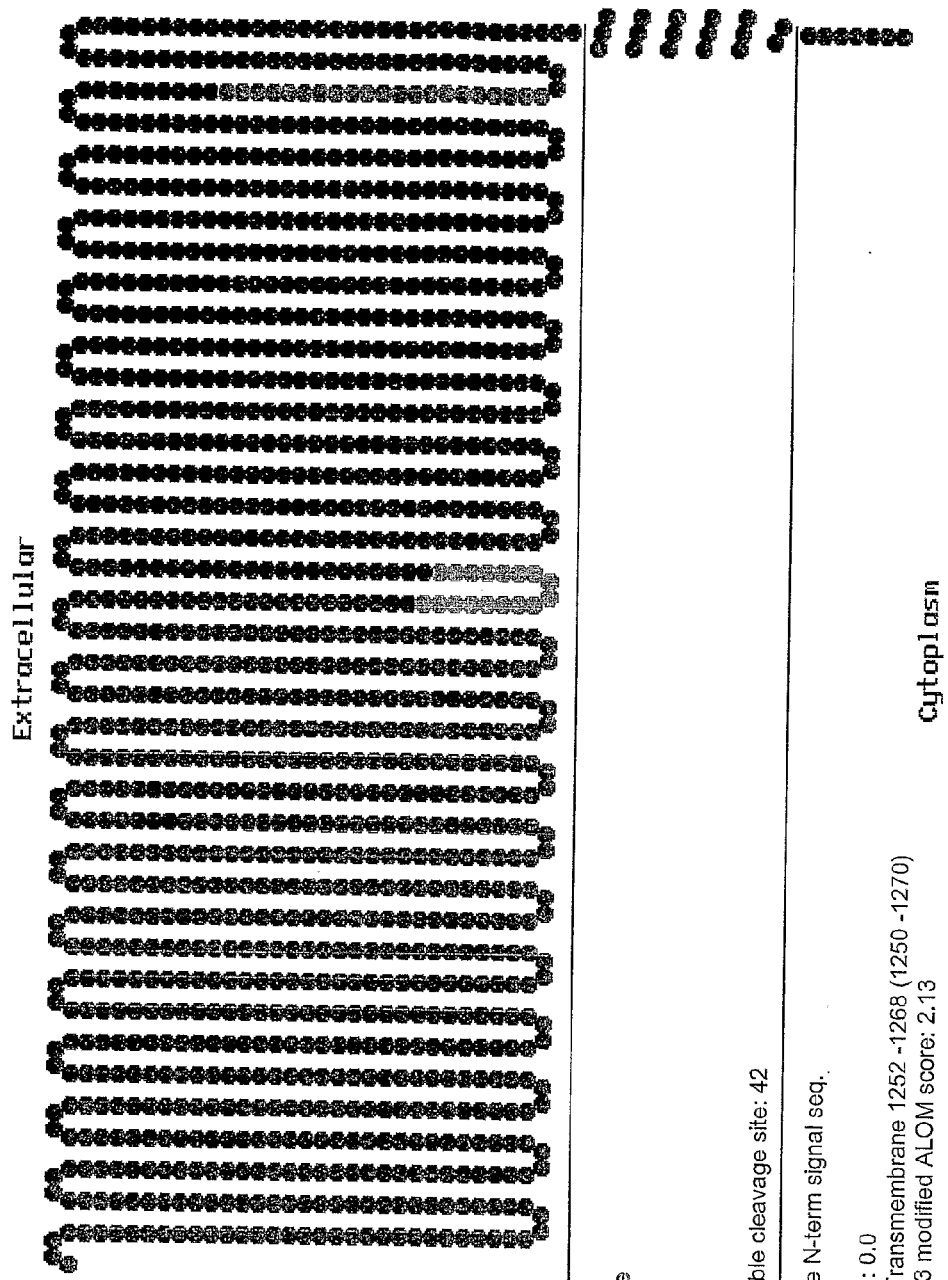
Figure 72:
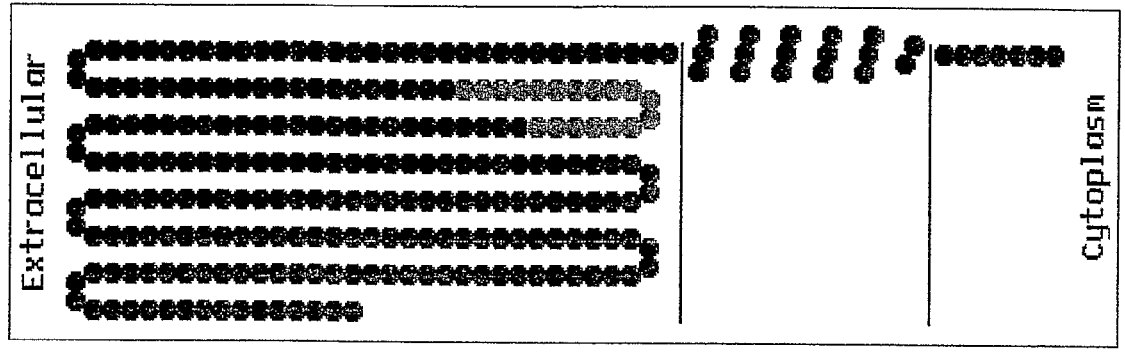
Figure 73:
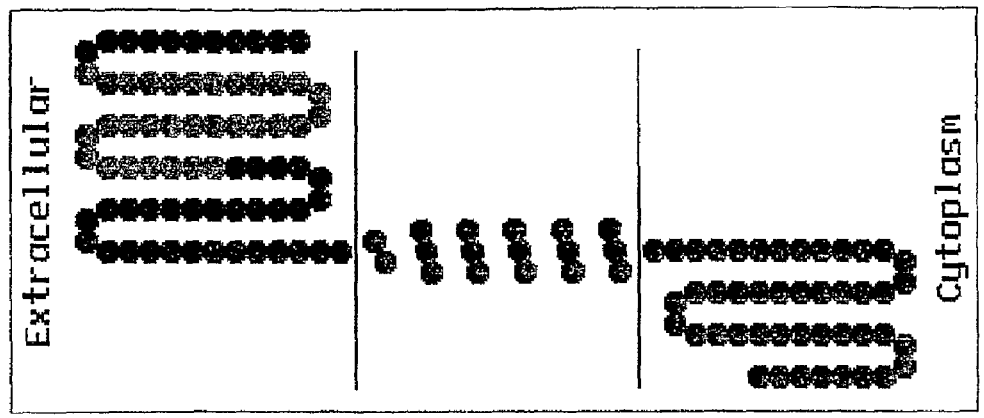
Figure 74:
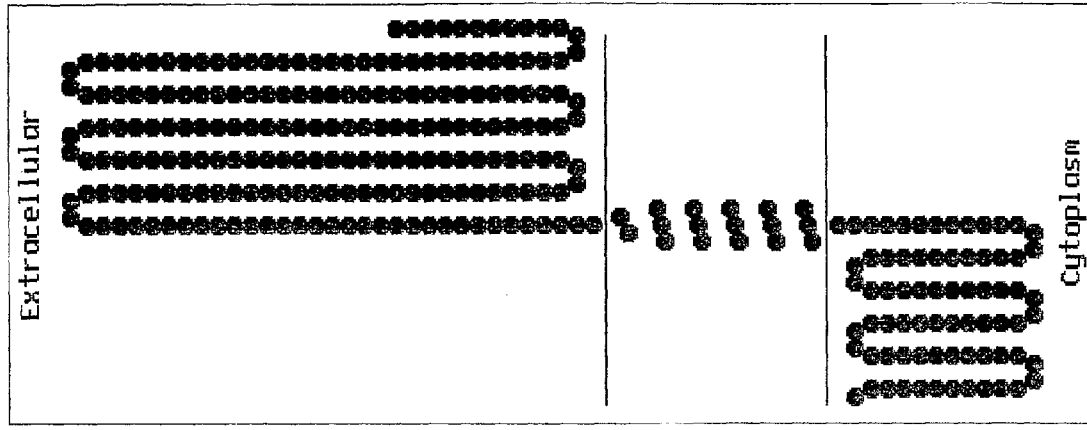
Figure 75:
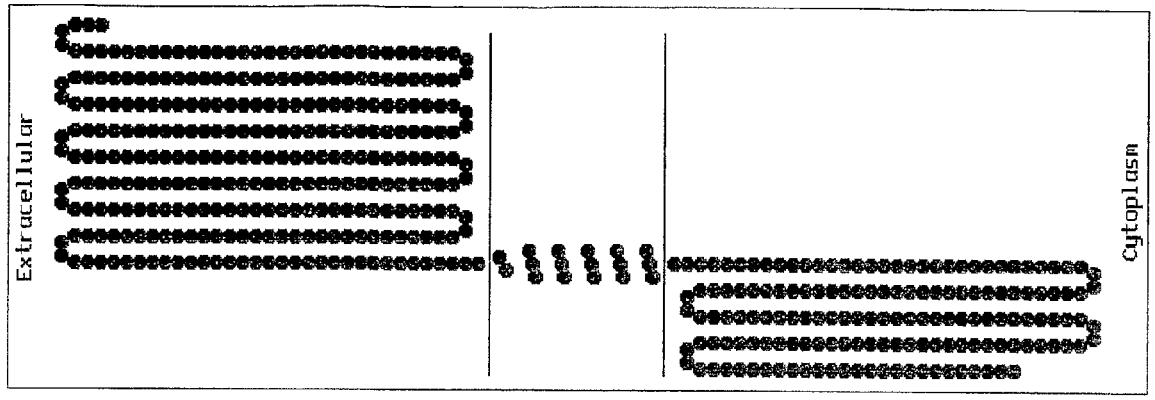
Figure 76:
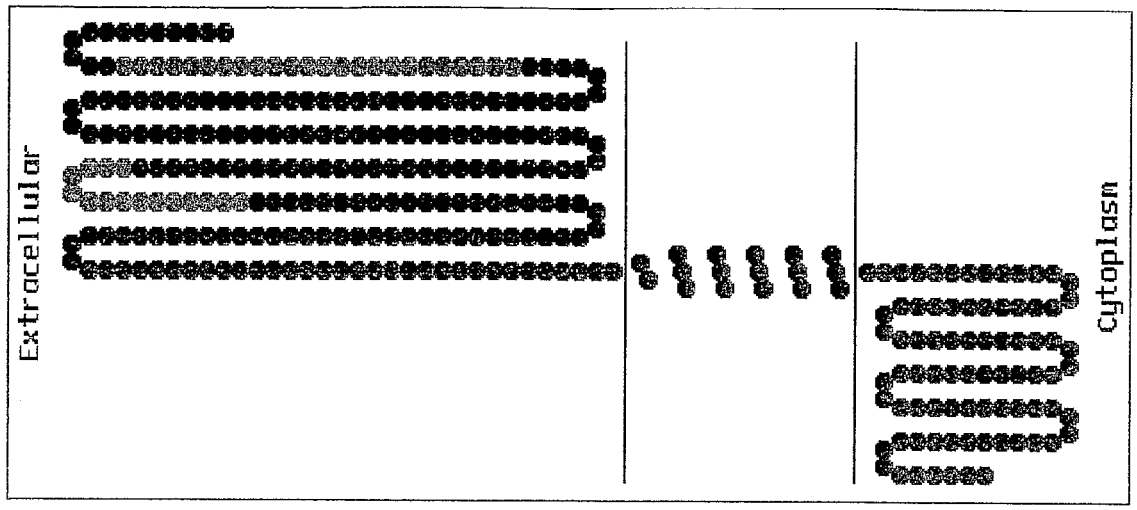
Figure 77:
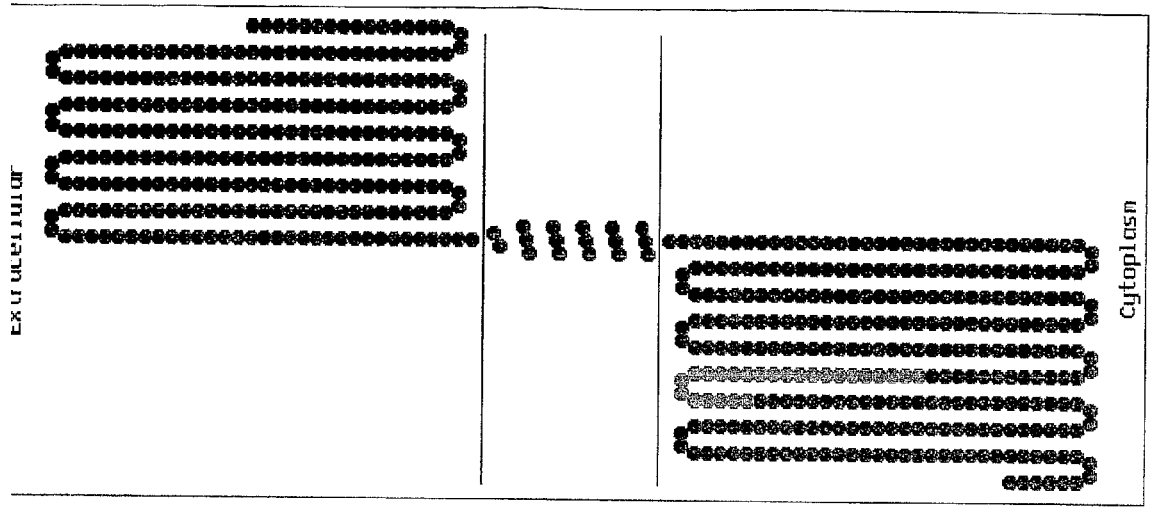
Figure 78:
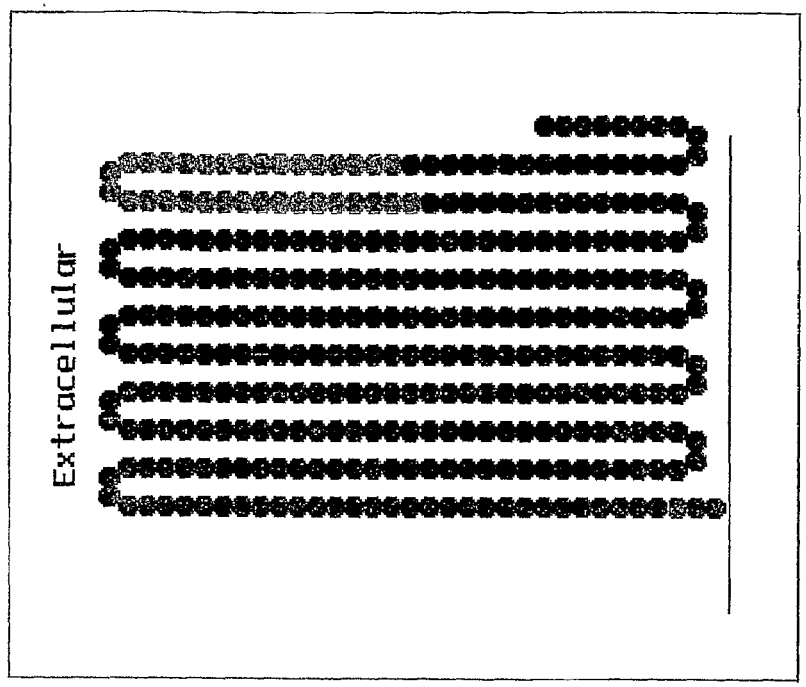
Figure 79:
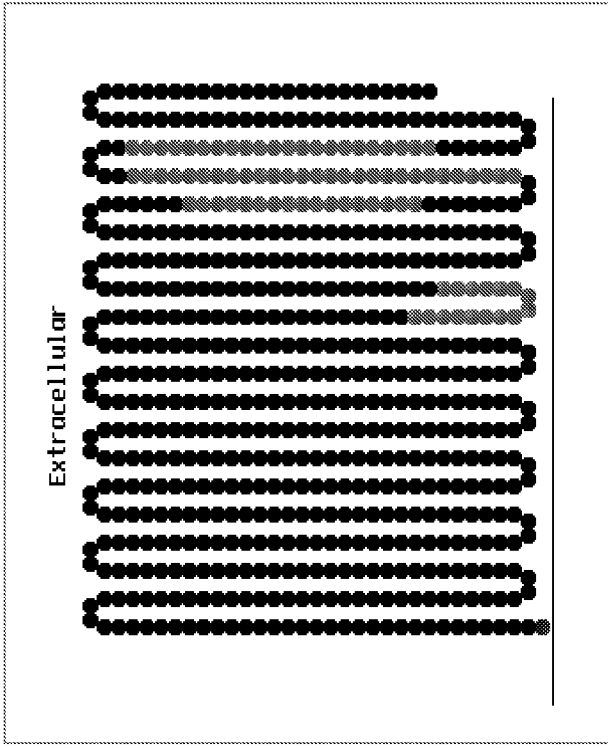
Figure 80:
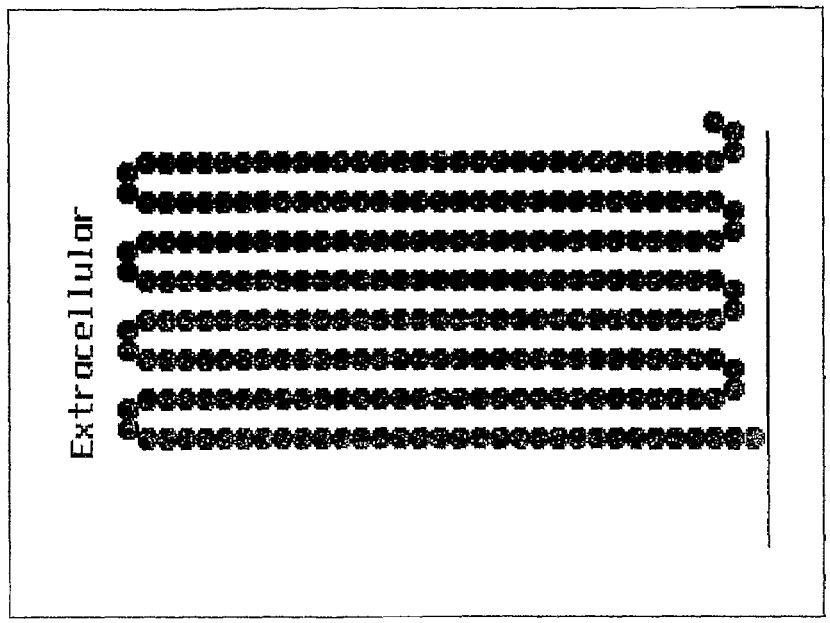
Figure 81:
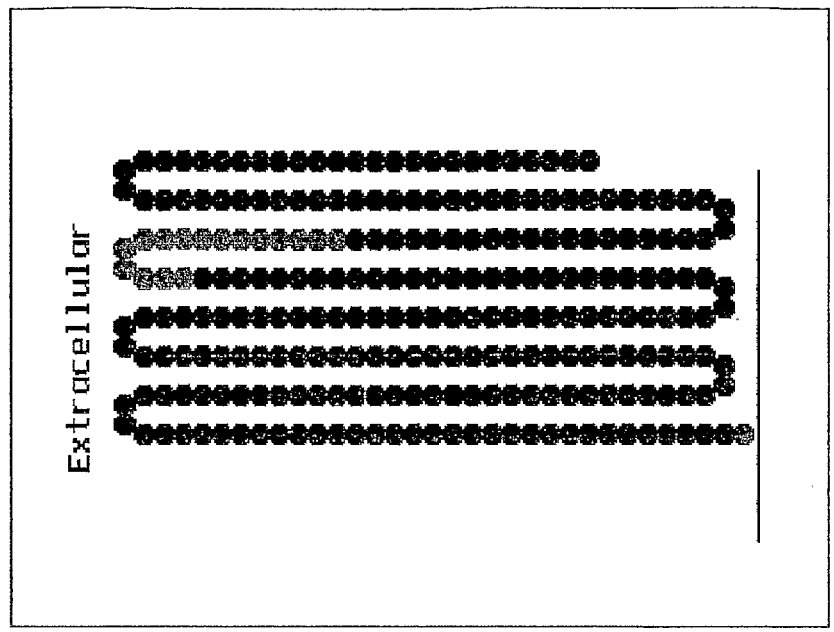
Figure 82:
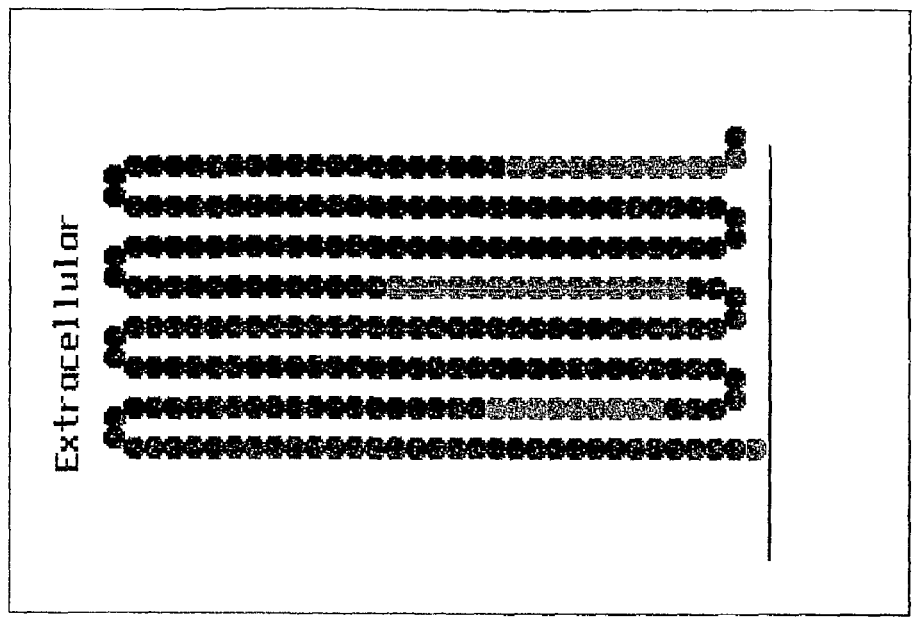
Figure 83:
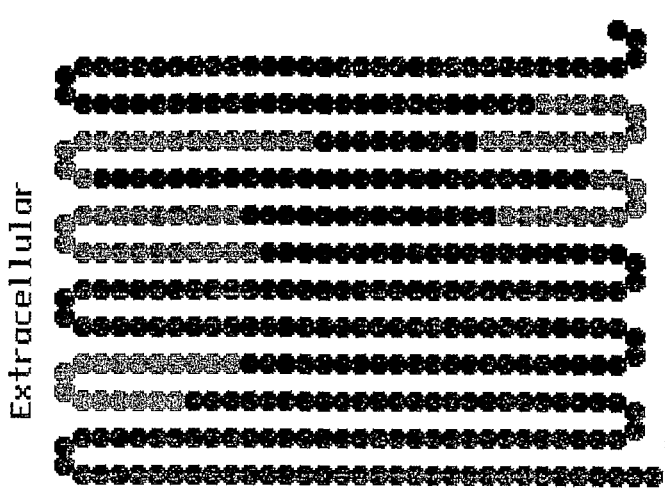
Figure 84:
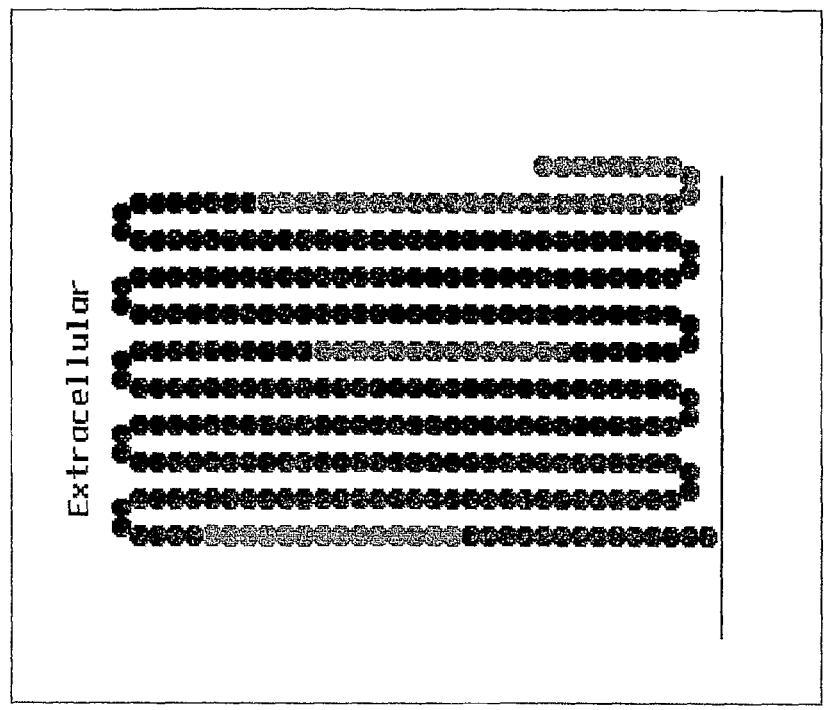
Figure 85:
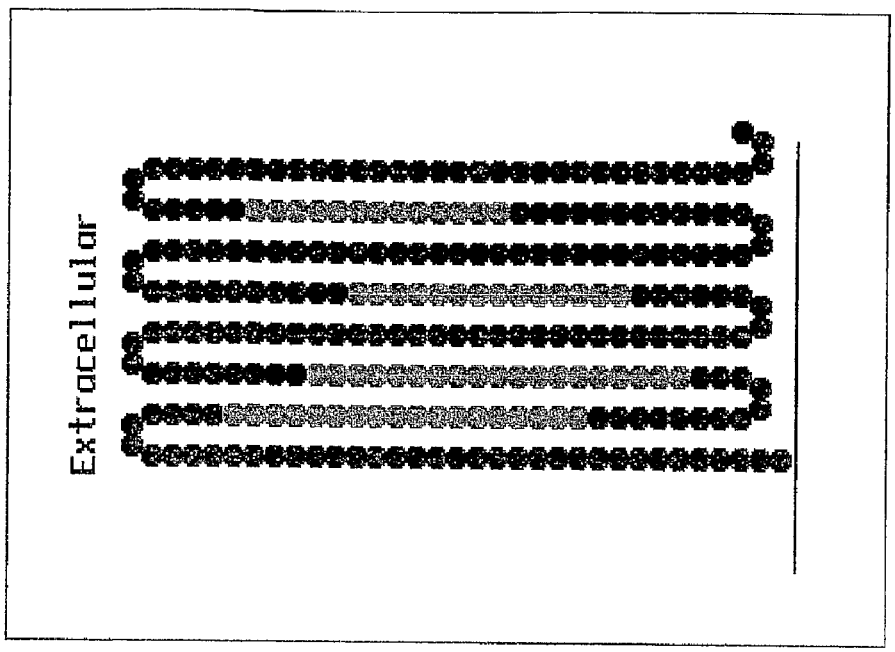
Figure 86:
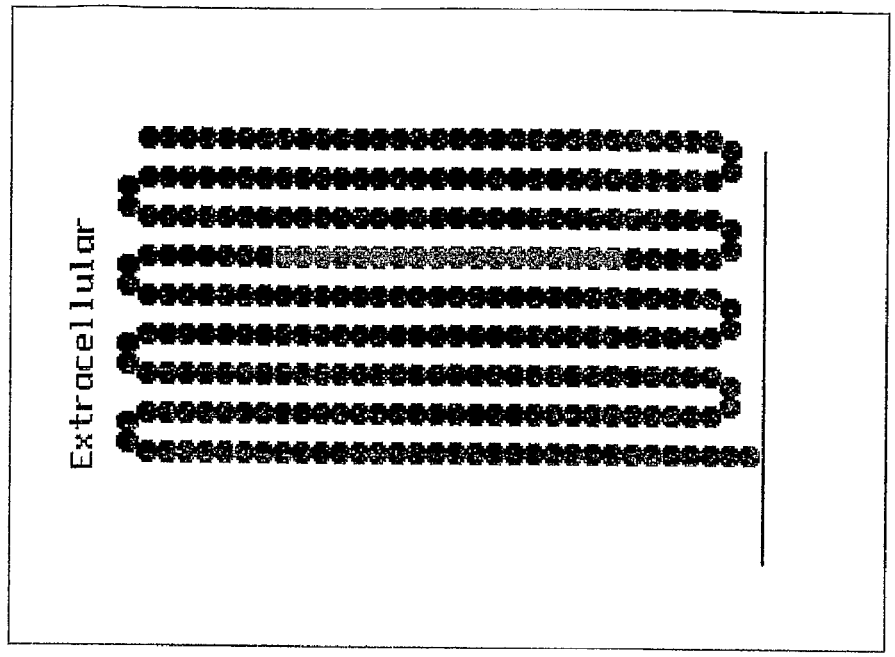
Figure 87:
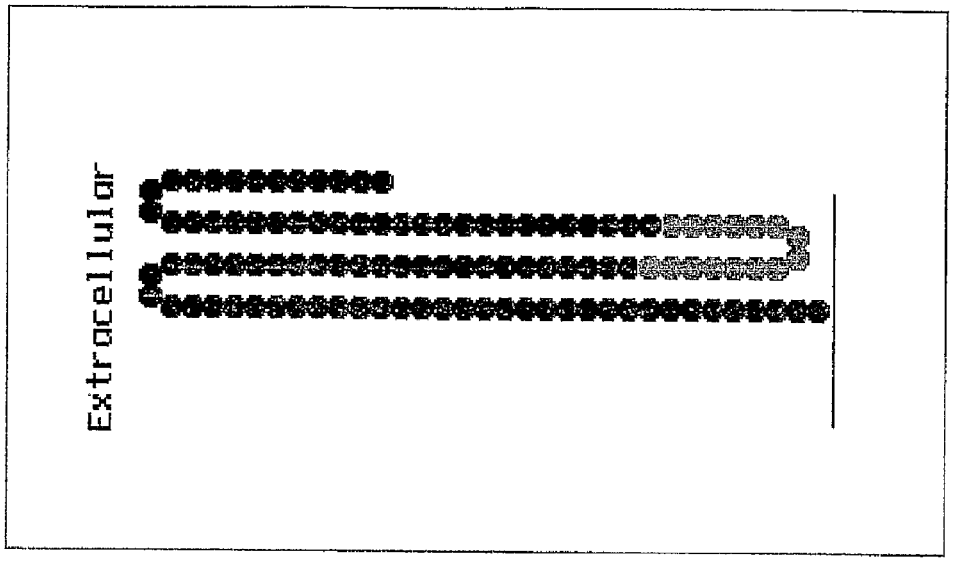
Figure 88:
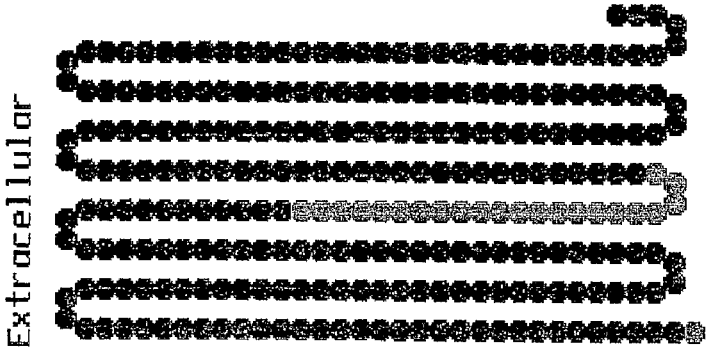
Figure 89:
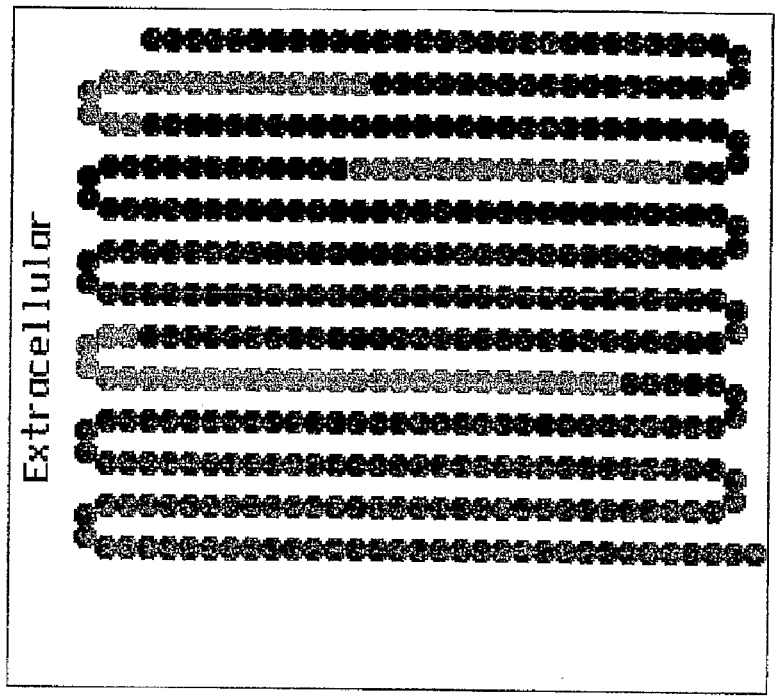
Figure 90:
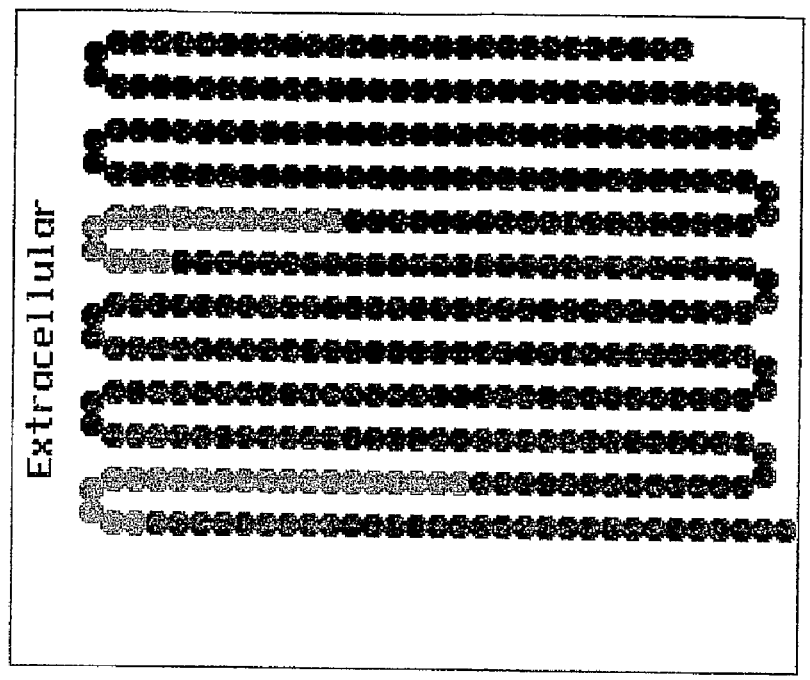
Figure 91:
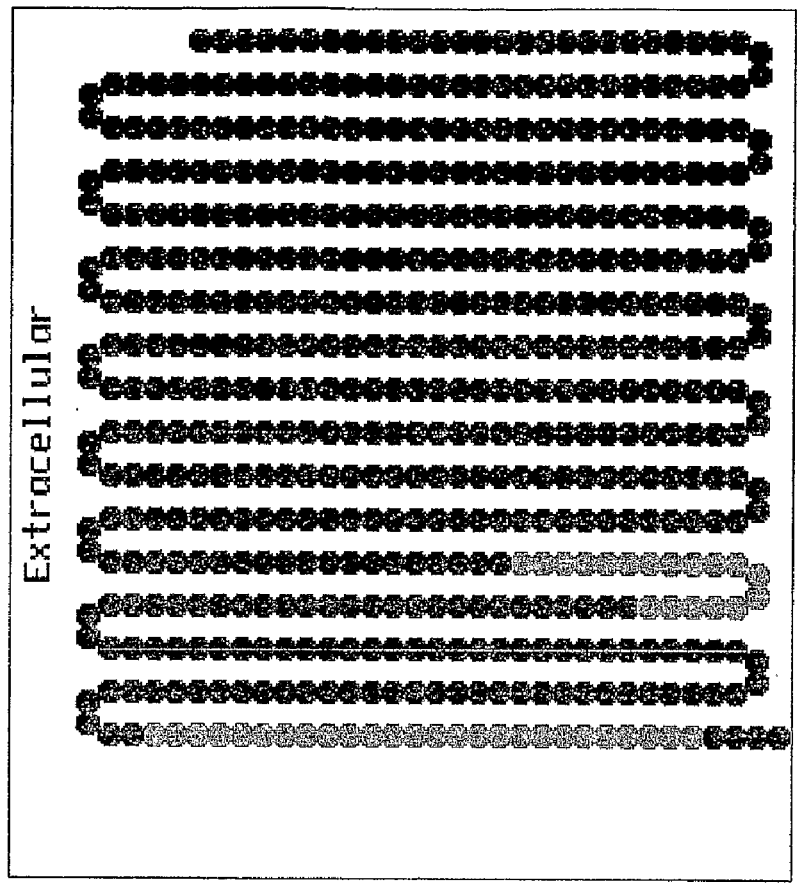
Figure 92:
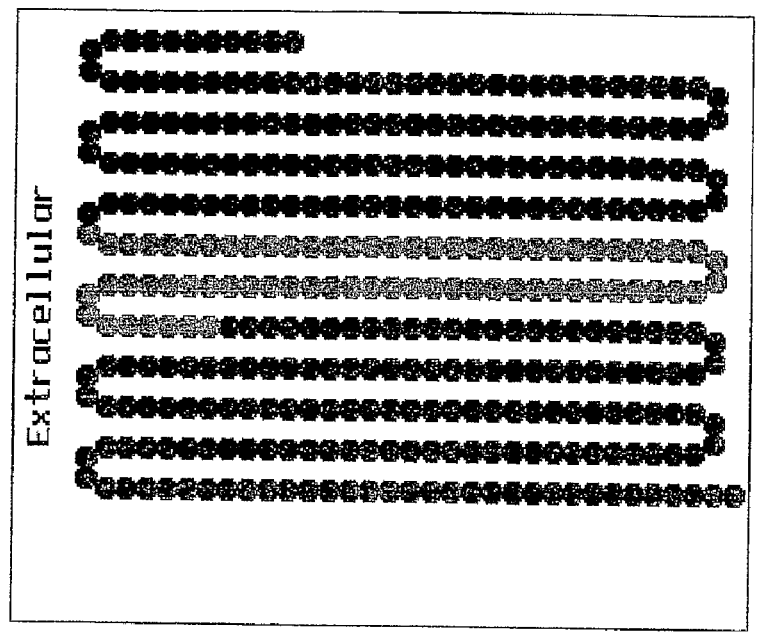
Figure 93:
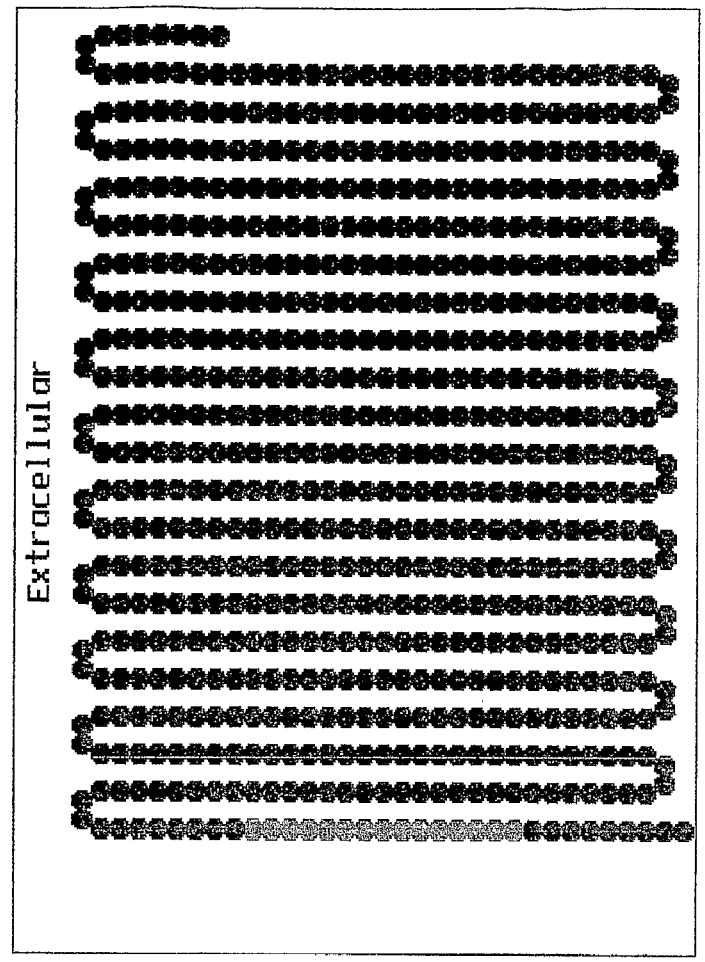
Figure 94:
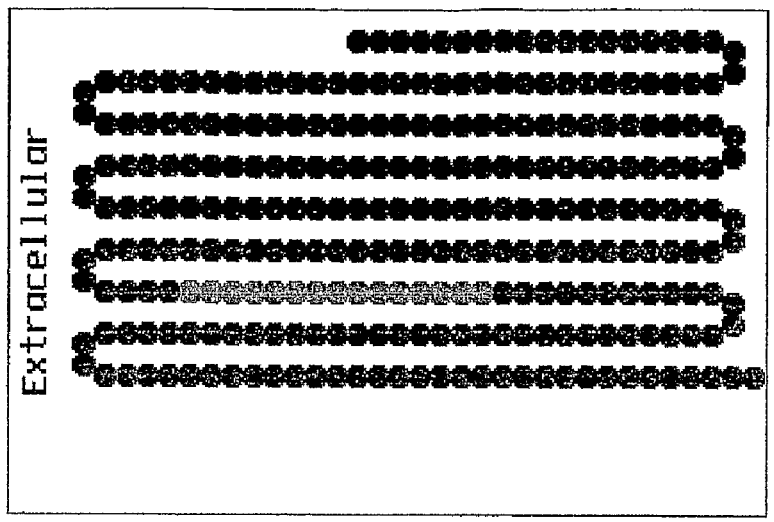
Figure 95:
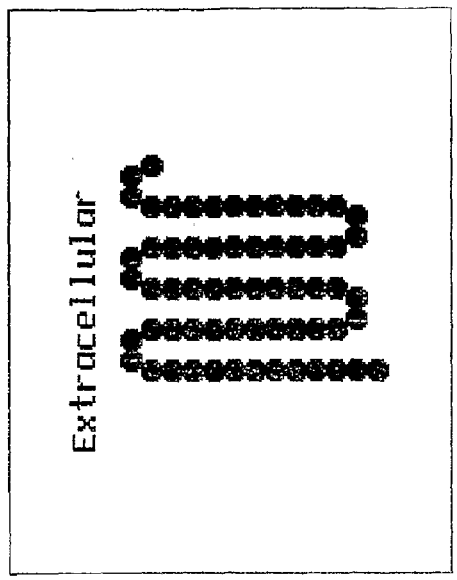
Figure 96:
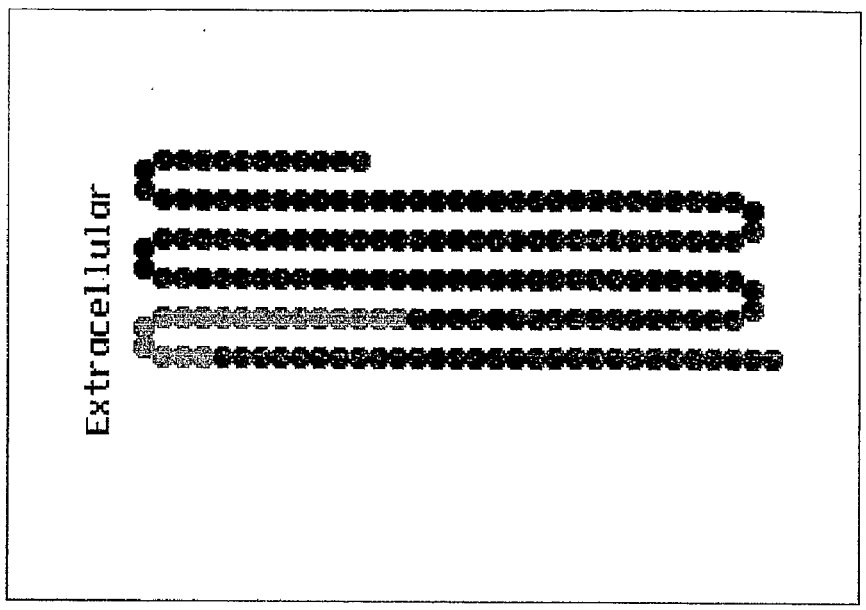
Figure 97:
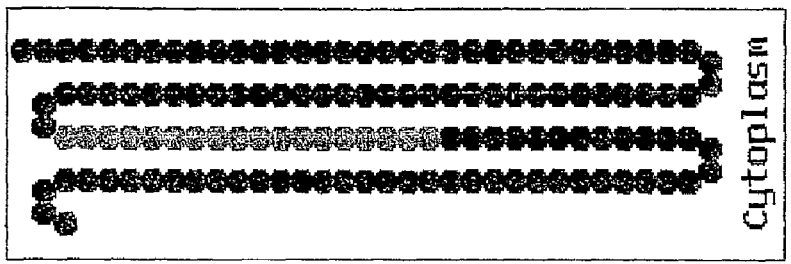
Figure 98:
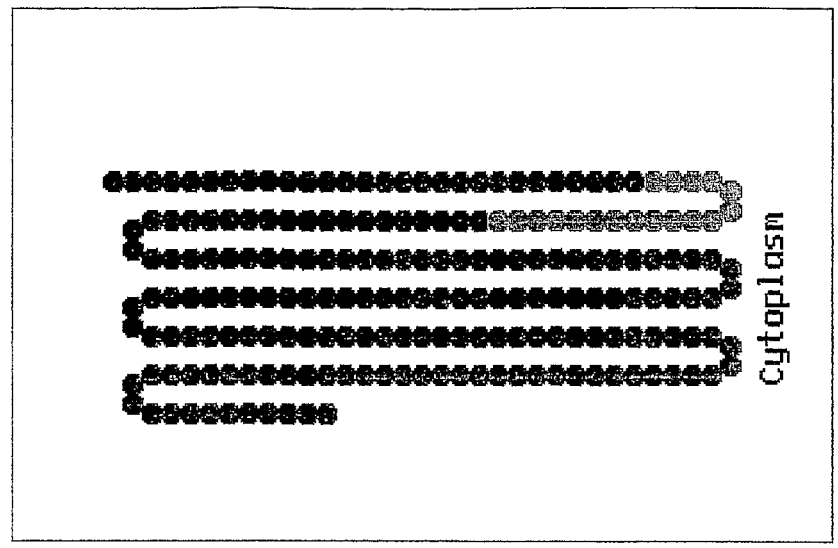
Figure 99:
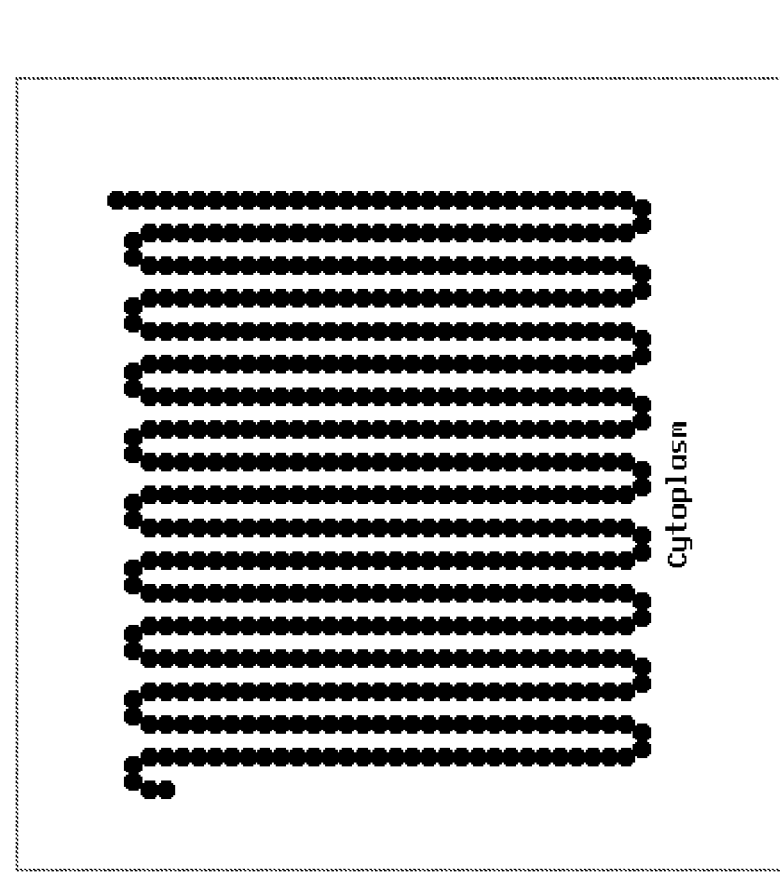
Figure 100:
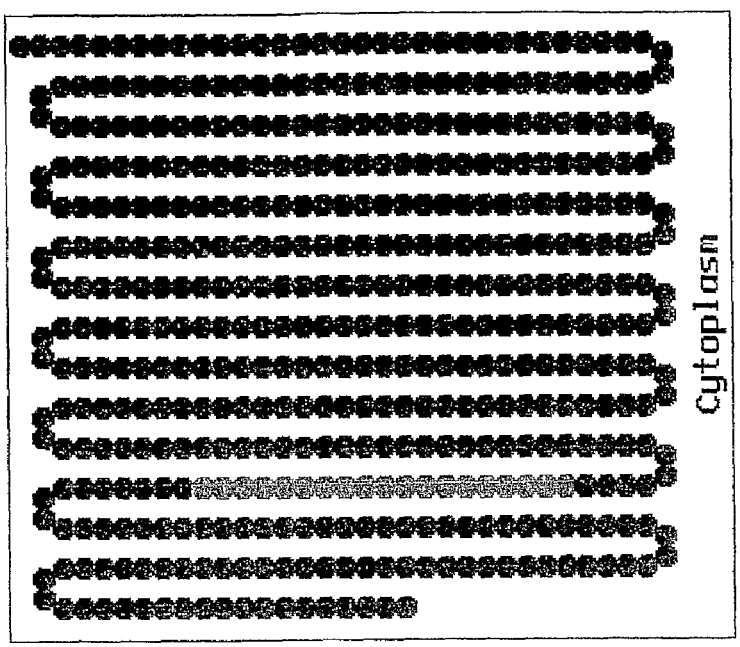
Figure 101:
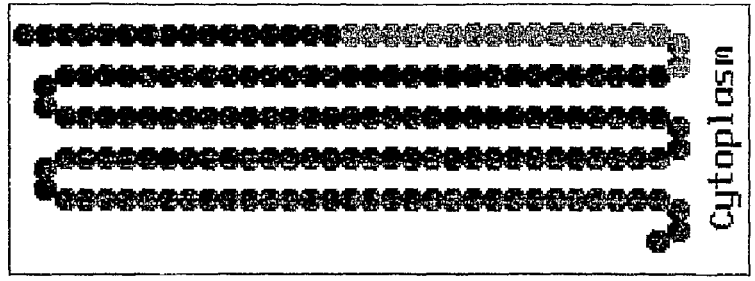
Figure 102:
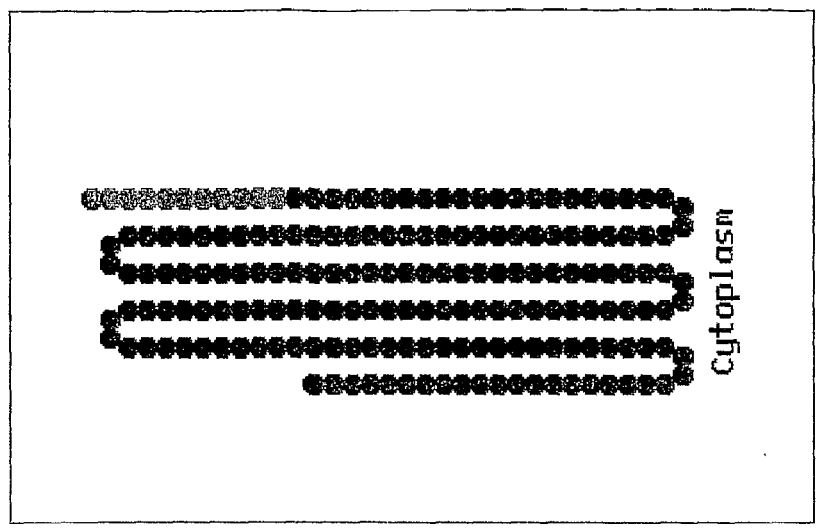
Figure 103:
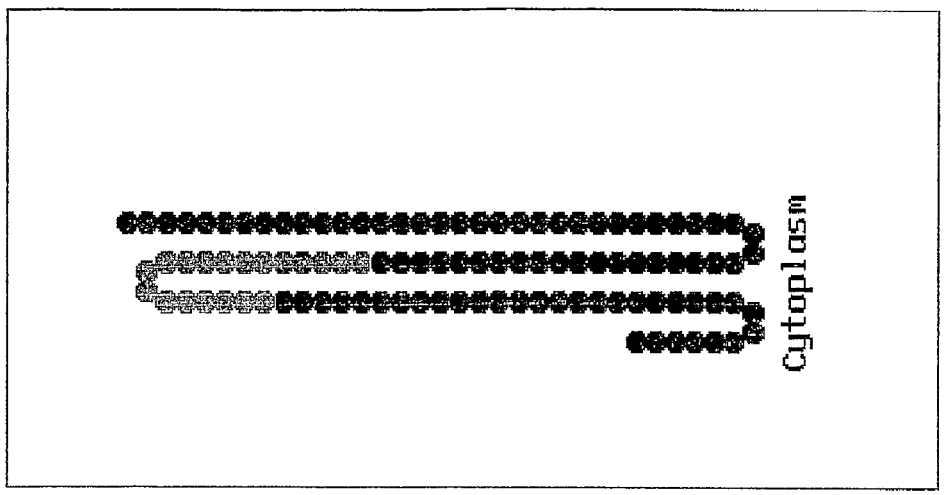
Figure 104:
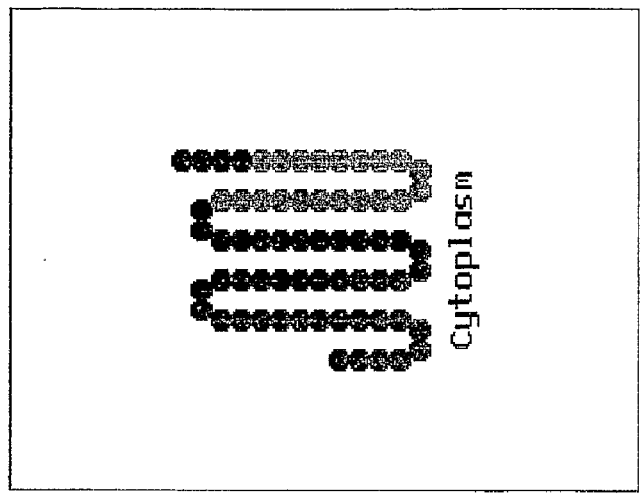

See also Tables 7 and 8 and FIGS. 28-104. Although the mass spectrometry technique is not quantitative, the M protein seemed to be the most abundant; 14 MS/MS spectra of M protein peptides were identified after trypsin digestion.

Most of the proteins (60) were identified from peptides generated by trypsin digestion. Proteinase K released peptides corresponding to 30 proteins; 19 proteins were identified by both enzymes. Proteinase K was especially useful for the recovery of peptides corresponding to membrane proteins with a high number of transmembrane domains (TMD): e.g., proteins NT01SP0454, NT01SP0906 and NT01SP1664, with 7, 10 and 4 TMD, respectively, which were not identified from trypsin digestion. The number of identified peptides per protein ranged from one to several tens.

FIGS. 25A-B and 26A-B show the high coverage obtained after digestion with both proteases of the cell-wall protein NT01SP1652 (GAS190; SEQ ID NO:117). GAS190 contains the anchoring sequence LPXTG (SEQ ID NO:931). It has been previously described as "OrfX" and belonging to the vir regulon, which organizes the expression of several bacterial virulence factors under the control of the Mga regulator. The function of GAS190 is, so far, unknown, although it may be a fibronectin-binding protein. The wall-associated region can cover from about 50 to as many as 125 amino acid residues.

Figure 25B:
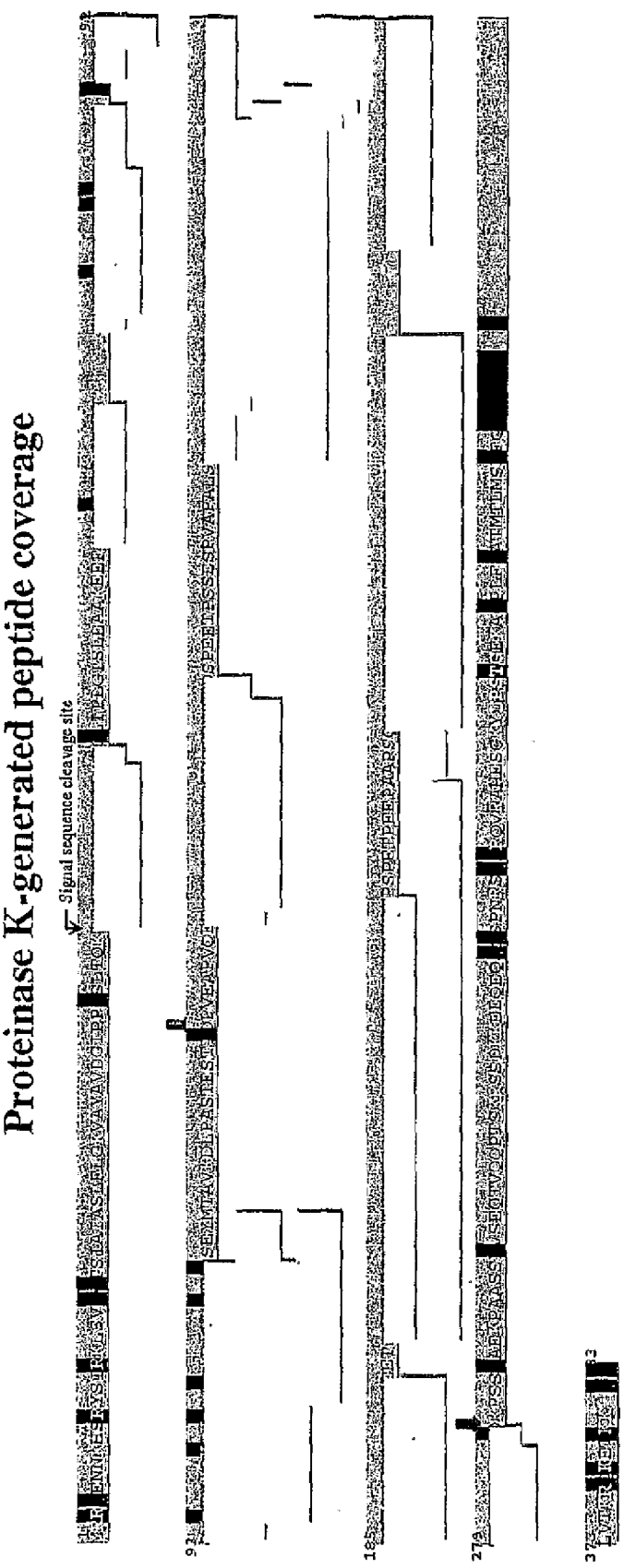

FIGS. 25A (SEQ ID NOS:932-949) and 25B show the coverage of the GAS190 protein sequence (50.6%) by the 35 proteinase K-generated peptides. The zone lacking coverage by tryptic peptides (shown in FIG. 25B between arrows) was widely represented under proteinase K digestion, although a high degree of redundant information was obtained. Most of the peptides identified corresponded to the most exposed region of the protein, i.e., the first half of the sequence from the N-terminus.

The 11 tryptic-generated peptides and their alignment along the GAS190 protein sequence are shown in FIGS. 26A (SEQ ID NOS:950-961) and 26B, resulting in a coverage of 34.6%. Peptides from the trypsin digestion were found as close as 13 amino acid residues to the LPXTG (SEQ ID NO:931) in the GAS190 protein. Note the absence of sites for trypsin digestion (K/R) between the two arrows in FIG. 2B, which makes the generation of tryptic species in that zone theoretically impossible. Only one peptide lacking K or R before its N-terminus was identified (VDGIPPISLTQK, SEQ ID NO:969), which corresponds to the actual N-terminus of the mature form of the protein according to PSORT predictions. Peptides having more than one trypsin-missed cleavage site (6 out of 11) were relatively abundant. For example, the peptide IKTAPDKDKLLFTYHSEYMTAVK (SEQ ID NO:970) contains 3 internal lysines that were not C-cleaved by trypsin; for some peptides of M protein, up to 6 cleavage sites were missed.

Not all the proteins identified were as extensively covered by their respective generated peptides. Proteins containing cell wall-anchoring motifs showed the highest degree of coverage. Proteins with at least one predicted TMD (according to PSORT prediction) were identified, in general, from a low number of peptides (Table 9).

EXAMPLE 15

Identification of GAS Surface Proteins After Overproduction of Membrane-Delimited Structures After Antibiotic Treatment (SF370 Serotype)

Figure 107:
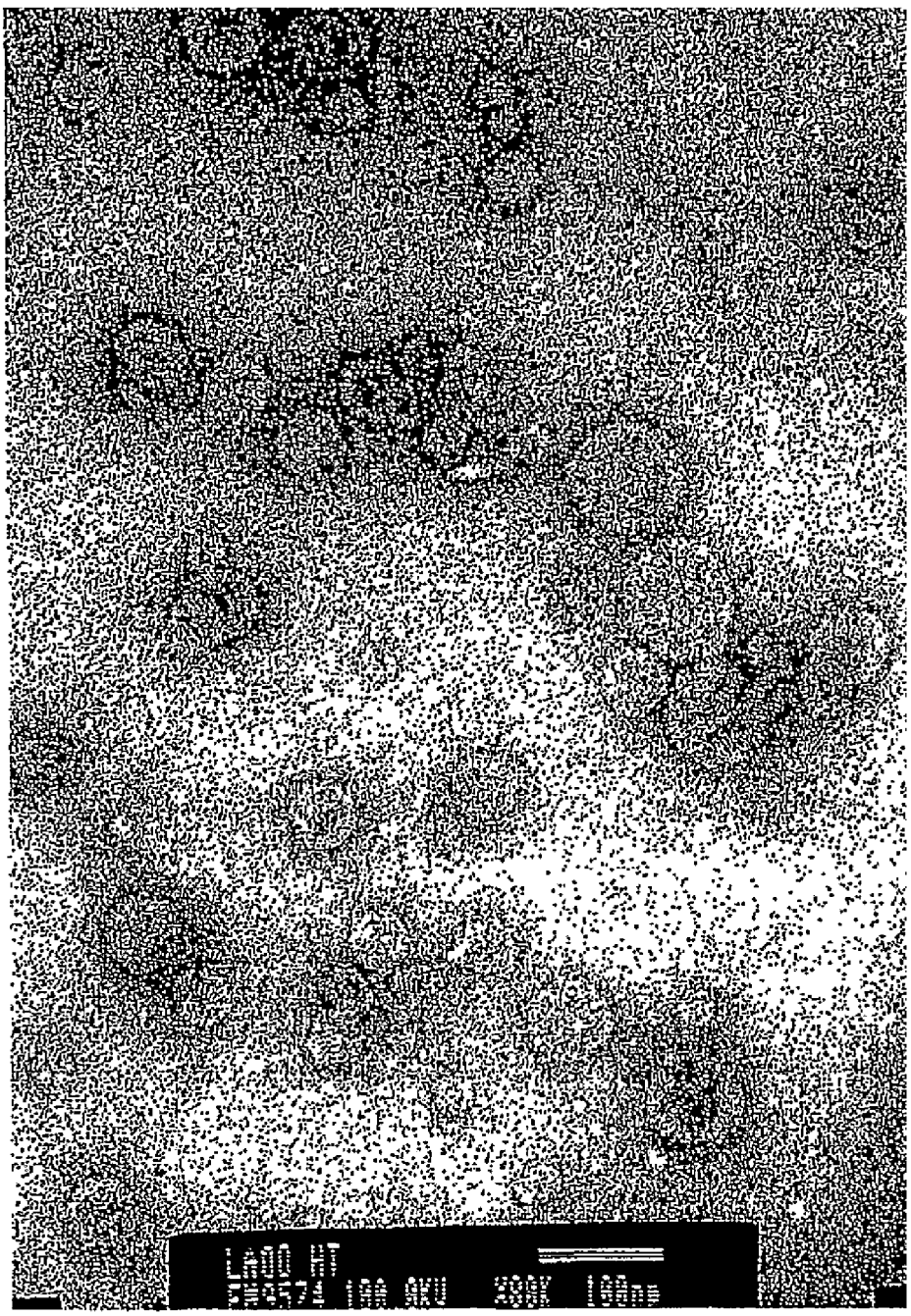
FIG. 107. Electron micrograph of membrane-delimited structures produced upon penicillin treatment of GAS bacteria.

Bacterial culture and antibiotic treatment. *Streptococcus pyogenes* SF370 cells were grown in THB at 37° C. and 5% $CO_2$, until an $OD_{600}$=0.4 was reached (exponential growth phase). Growth medium was harvested after centrifugation at 3,500×g for 10 minutes at 4° C. Bacterial suspension was diluted twofold by adding THB containing antibiotics (0.7 μg/ml penicillin; 10 μg/ml vancomycin, final concentration) and the culture was left for 80 min. FIG. 107 is an electron micrograph showing membrane-delimited structures produced upon penicillin treatment.

Recovery of membrane-delimited structures. Supernatant was filtered (0.22 μm) and membrane-delimited structures were recovered by ultracentrifuge at 200,000×g for 90 minutes at 4° C. The pellet was then washed once in PBS and then resuspended in the same buffer.

Proteomic analysis of membrane-delimited structures. Ultracentrifugation pellets were subjected to SDS-PAGE. The bands thus separated were picked, destained, trypsin-digested, desalted by using Zip-Tips (Millipore), and analyzed by MALDI-TOF using an Ultraflex MALDI-TOF/TOF mass spectrometer (Bruker Daltoniks). MASCOT software was used for spectra analysis and identification.

Proteins identified by this method are shown in Table 8. The majority of the identified proteins are surface-exposed proteins (secreted, membrane-bound, or lipoproteins). No cell wall proteins were observed either in this fraction or in the membrane-delimited structures. Thus, most of the protein content of the membrane-delimited structures is of potential interest for vaccine development.

EXAMPLE 16

Identification of GAS Surface Proteins After Chemical Fractionation (SF370 Serotype)

Bacterial pellet preparation. Bacteria (GAS SF370) were grown in 250 ml THB at 37° C. and 5% CO2 until an OD600=0.4 was reached (exponential growth phase). After culture, bacteria were harvested by centrifugation at 3,500×g for 10 minutes at 4° C. and washed with phosphate-buffered saline (PBS). Bacteria were re-suspended in 20 ml of 6M guanidinium (urea or SDS also could be substituted for guanidinium), 200 mM Tris HCl and disrupted with 3 cycles at 1.7 kBar in a Basic Z 0.75V Model Cell Disrupter equipped with an "one shot head" (Constant System Ltd, Northants, England). The lysate was then centrifuged at 20,000×g for 20 minutes at 4° C. The resulting supernatant was filtered through a 0.22 µm membrane and spun in an ultracentrifuge at 200,000×g for 2 hours at 4° C. The pellet was washed with PBS (200,000×g for 30 minutes at 4° C.).

Total digestion. Three hundred microliters containing 10 µg of trypsin in 50 mM ammonium bicarbonate, 5 mM DTT was added to the pellet. Digestion was allowed to proceed overnight at 37° C.

Separation by SDS-PAGE. Three hundred microliters containing 9 µg of mutanolysin in 50 mM Tris-HCl pH7.5 was added to the pellet. Digestion was allowed to proceed 3 hours at 37° C., which permits the proteins to enter the gel. Proteins were separated by electrophoresis in a 12% polyacrylamide gel.

In-gel protein digestion and sample preparation for mass spectrometry analysis. Protein spots bands were excised from the gels, washed with 100 mM ammonium bicarbonate/acetonitrile 50/50 (V/V), and dried using a SpeedVac centrifuge (Savant, Holbrook, N.Y.). Dried spots were digested 2 hours at 37° C. in 12 µl of 0.012 µg/µl sequencing grade modified trypsin (Promega, Madison, Wis.) in 50 mM ammonium bicarbonate. After digestion, 5 µl of 0.1% trifluoacetic acid was added, and the peptides were desalted and concentrated with ZIP-TIPs (C18, Millipore).

Peptides were eluted with 2 µl of 5 g/l 2,5-dihydroxybenzoic acid in 50% acetonitrile/0.1% trifluoroacetic acid onto the mass spectrometer Anchorchip 384 (400 µm, Bruker Daltonics, Bremen, Germany), allowed to air dry at room temperature, and analysed by matrix-assisted matrix-assisted laser desorption/ionization-time of flight mass spectrometry. Mass spectra were collected on a Bruker UltraFlex mass spectrometer, calibrated using a peptide calibration standard (1000-4000 Da) from Bruker (part no206195). Peptide masses were determined using FlexAnalysis (Version 2.2, Bruker). Protein spot identifications were carried out by both automatic and manual comparison of experimentally generated monoisotopic values of peptides in the mass range of 1000-3500 Da with computer-generated fingerprints using Mascot software.

Results. Fragmentation of peptide of m/z 1372.7, 1202.6 identified the C5A peptidase precursor (15675796). Fragmentation of peptides of m/z 1706.8, 1880.1 identified the M protein type 1 (15675799).

EXAMPLE 17

Surfome Analysis of the Highly Capsulated Strain M3

GAS is surrounded by a hyaluronic acid-based capsule whose thickness can vary from strain to strain. Capsule plays an important role in bacterial virulence, and in general the highly capsulated strains are the most virulent strains. It is expected that the number of proteins with accessible external domains will depend on the thickness of the surrounding capsule. To verify that, we characterized the surfome of the highly capsulated strain M3.

Figure 108:
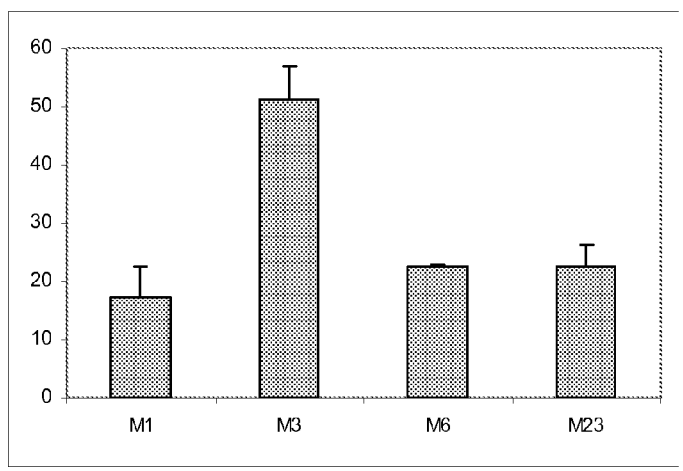
FIG. 108. Graph showing hyaluronic acid content of M1, M3, M6, and M23 GAS bacteria (fg/CFU).
Figure 109A:
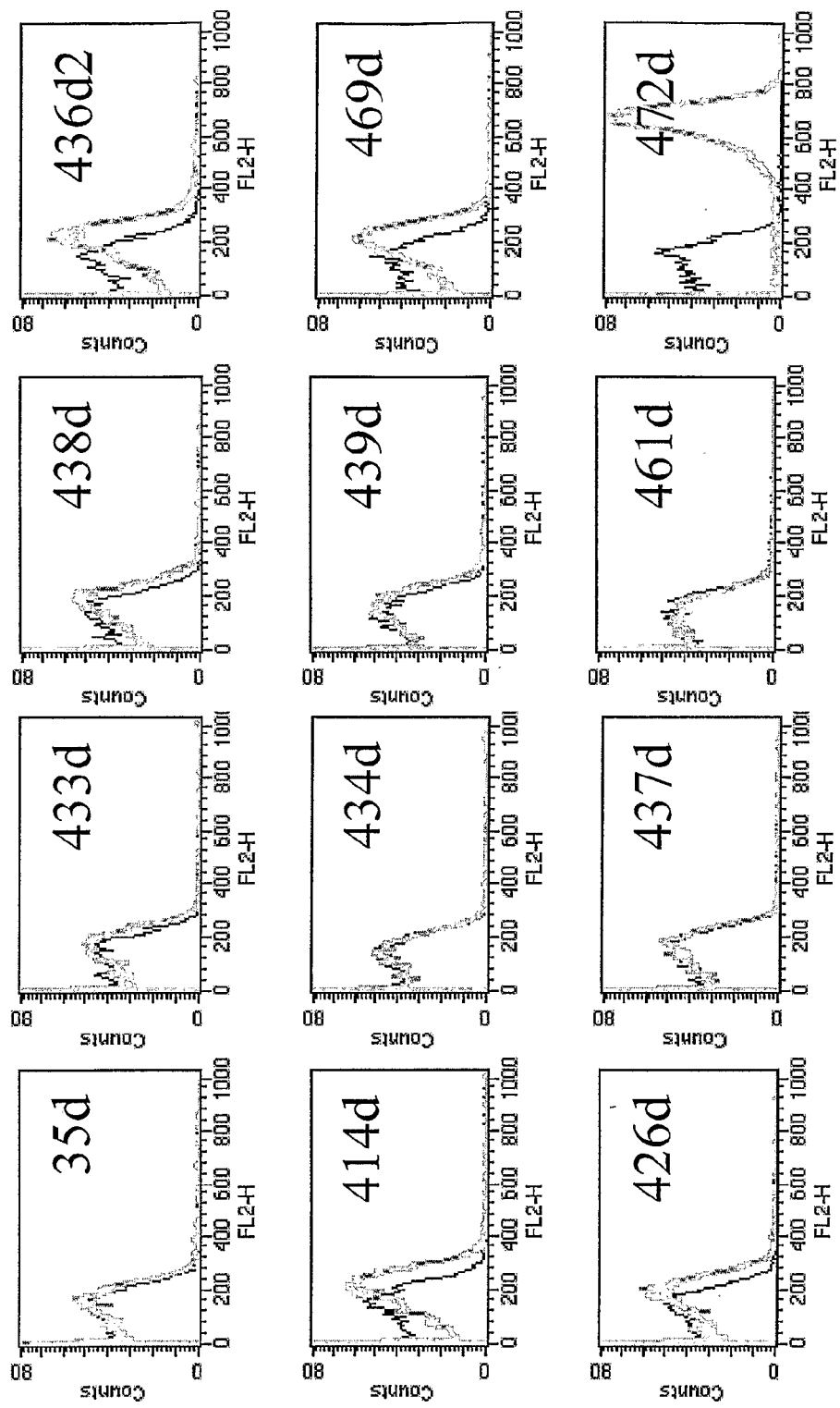
FIG. 109A-C. FACS pictograms of surface-exposed GAS antigens.
Figure 109B:
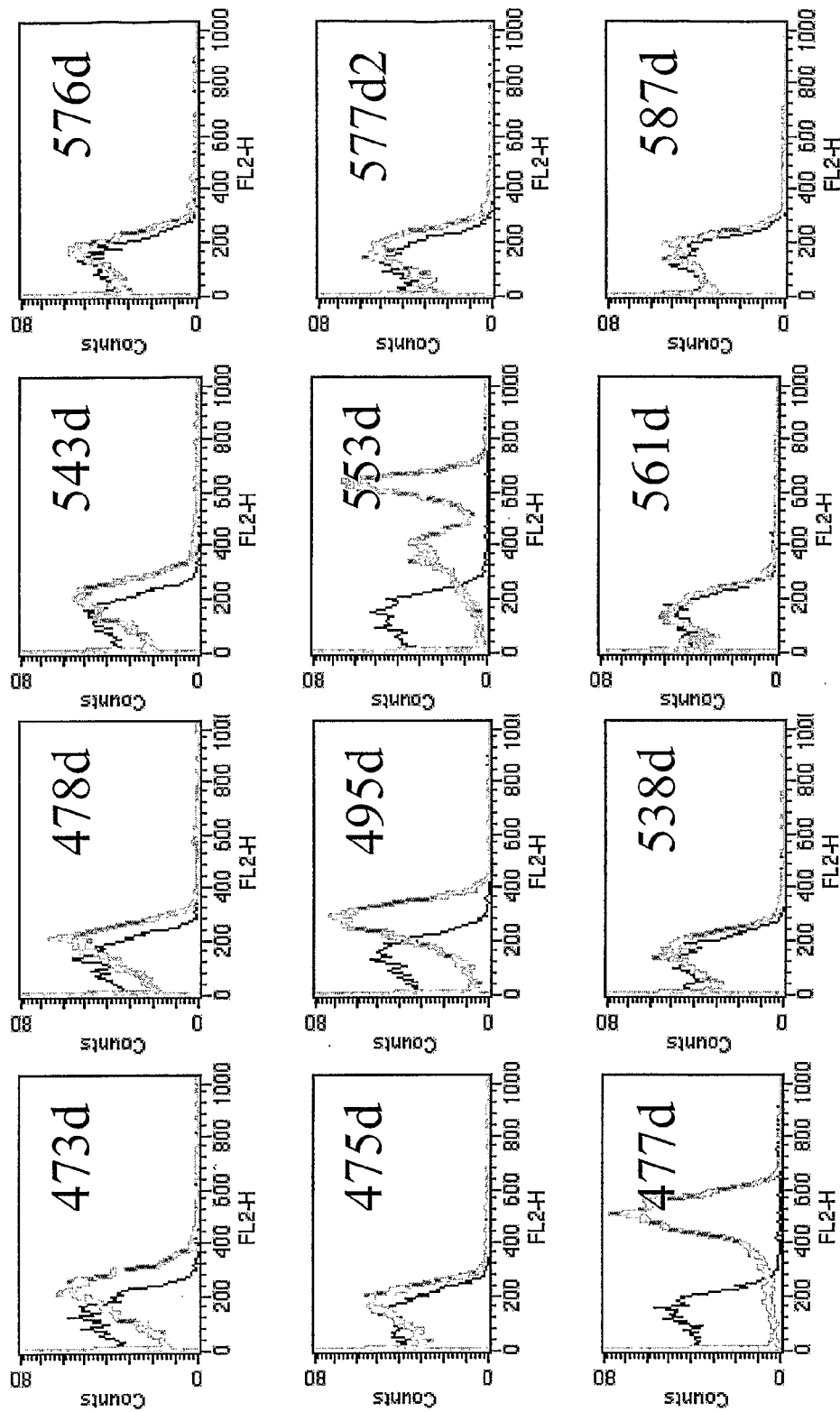
Figure 109C:
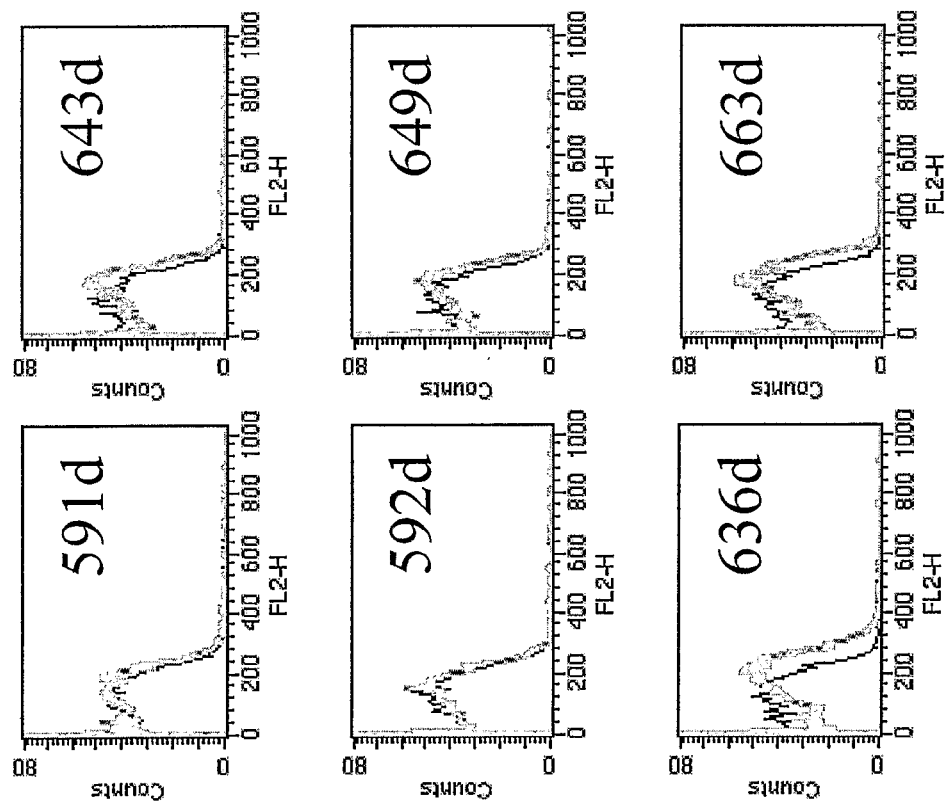
Figure 110A:
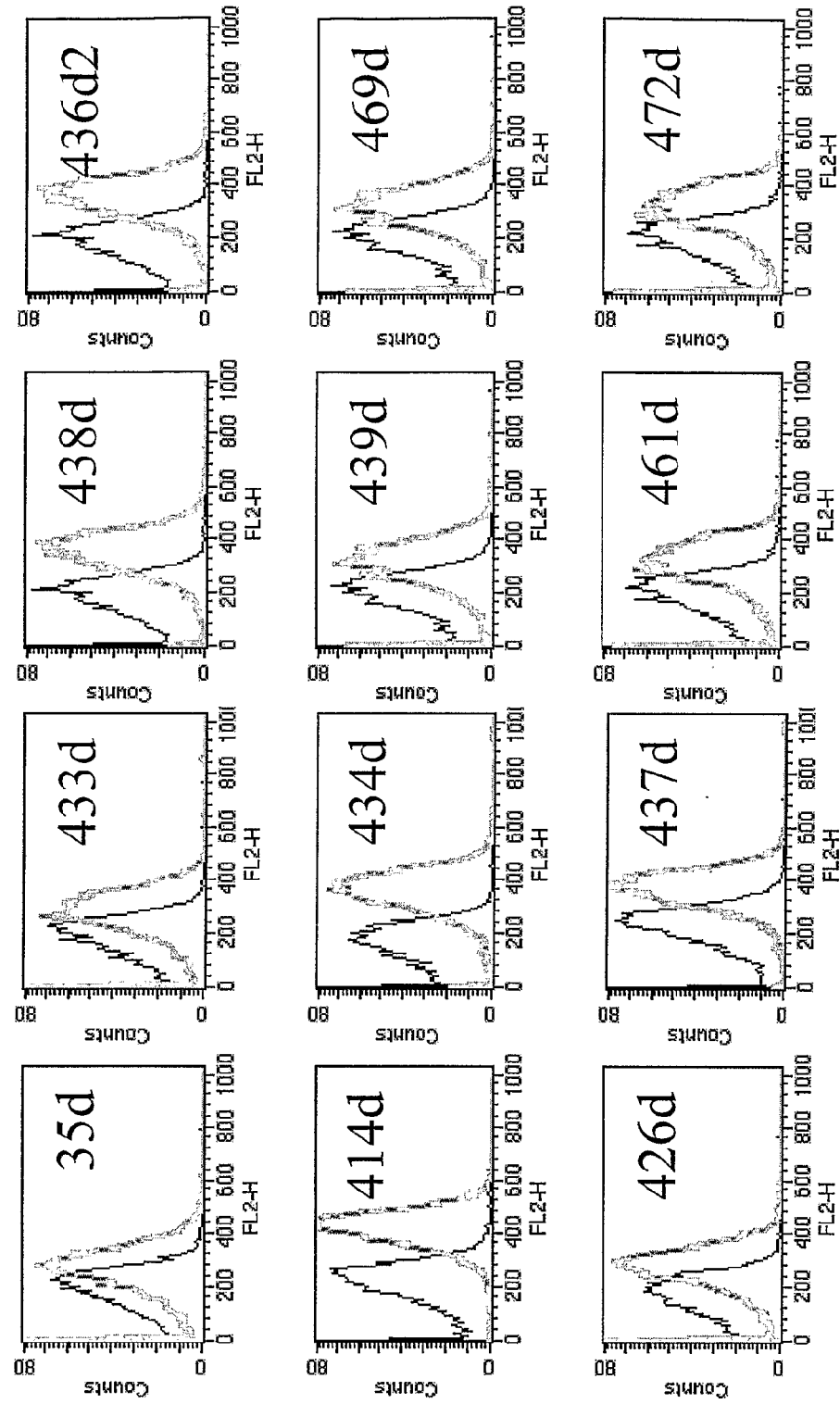
Figure 110C:
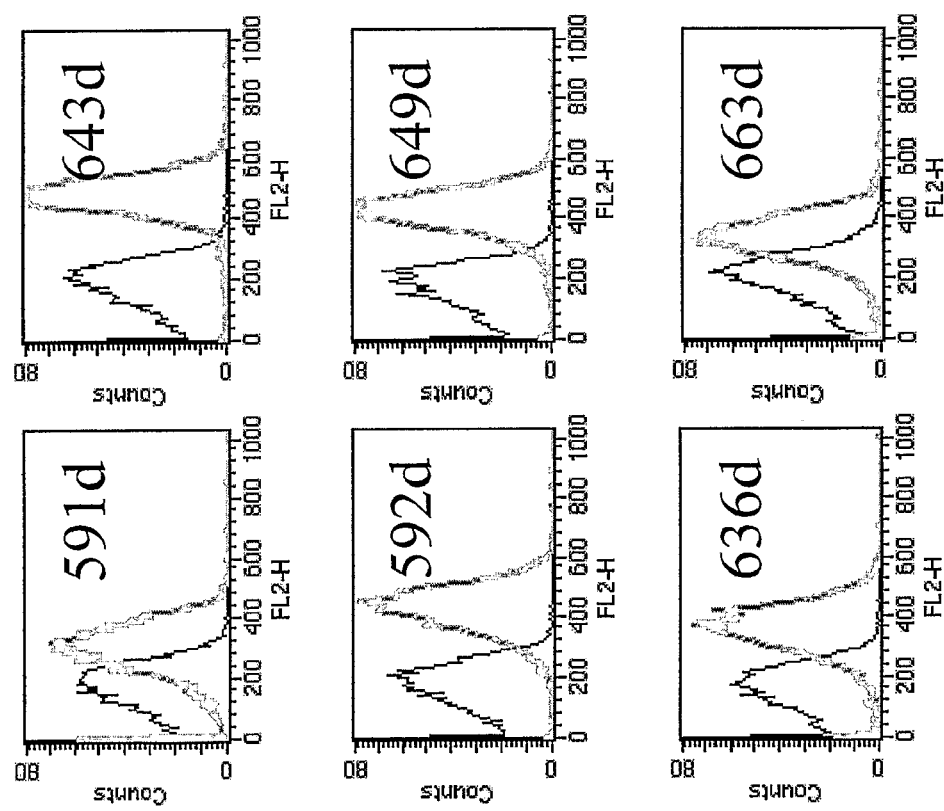
Figure 111A:
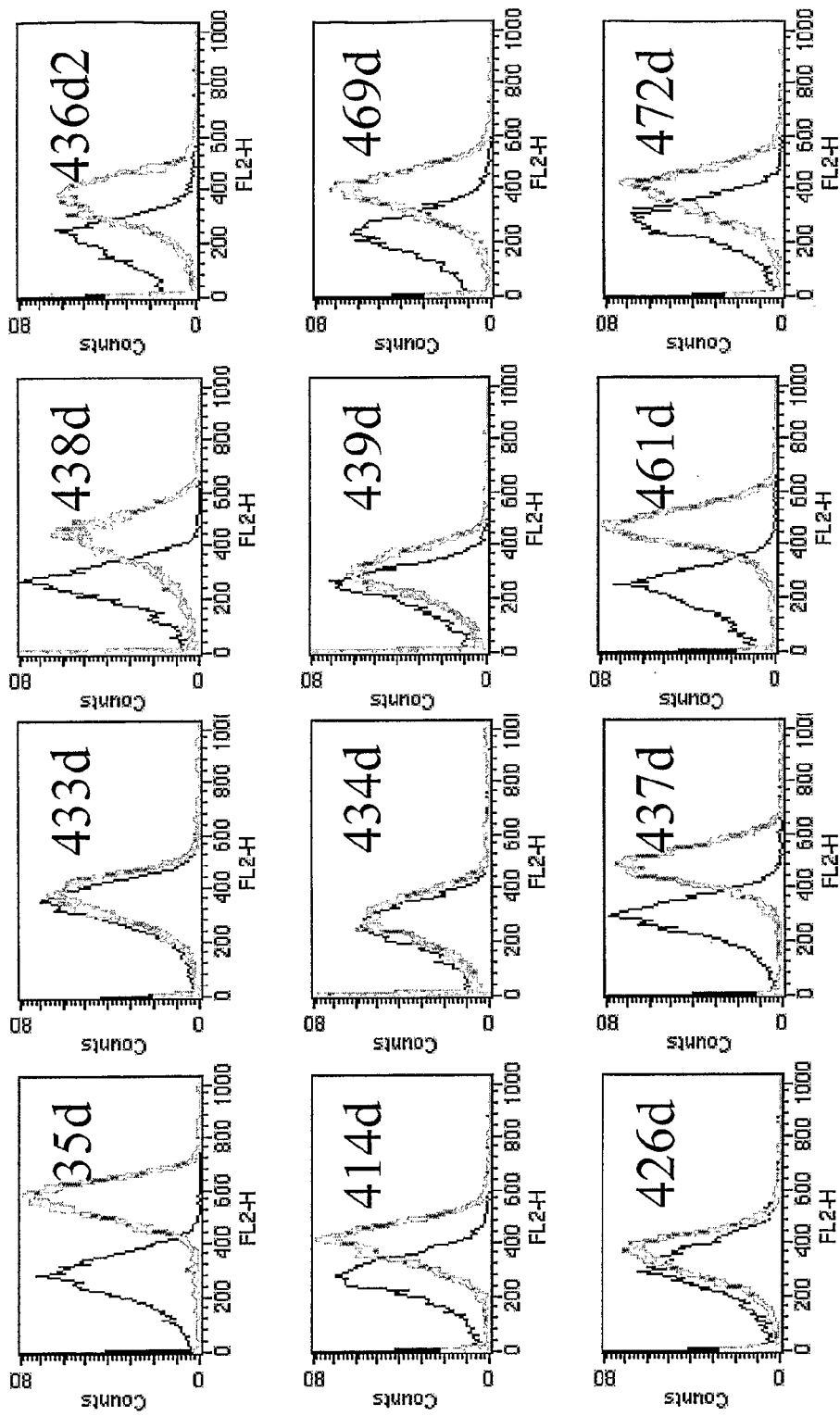
FIG. 111A-C. FACS pictograms of surface-exposed GAS antigens.
Figure 111B:
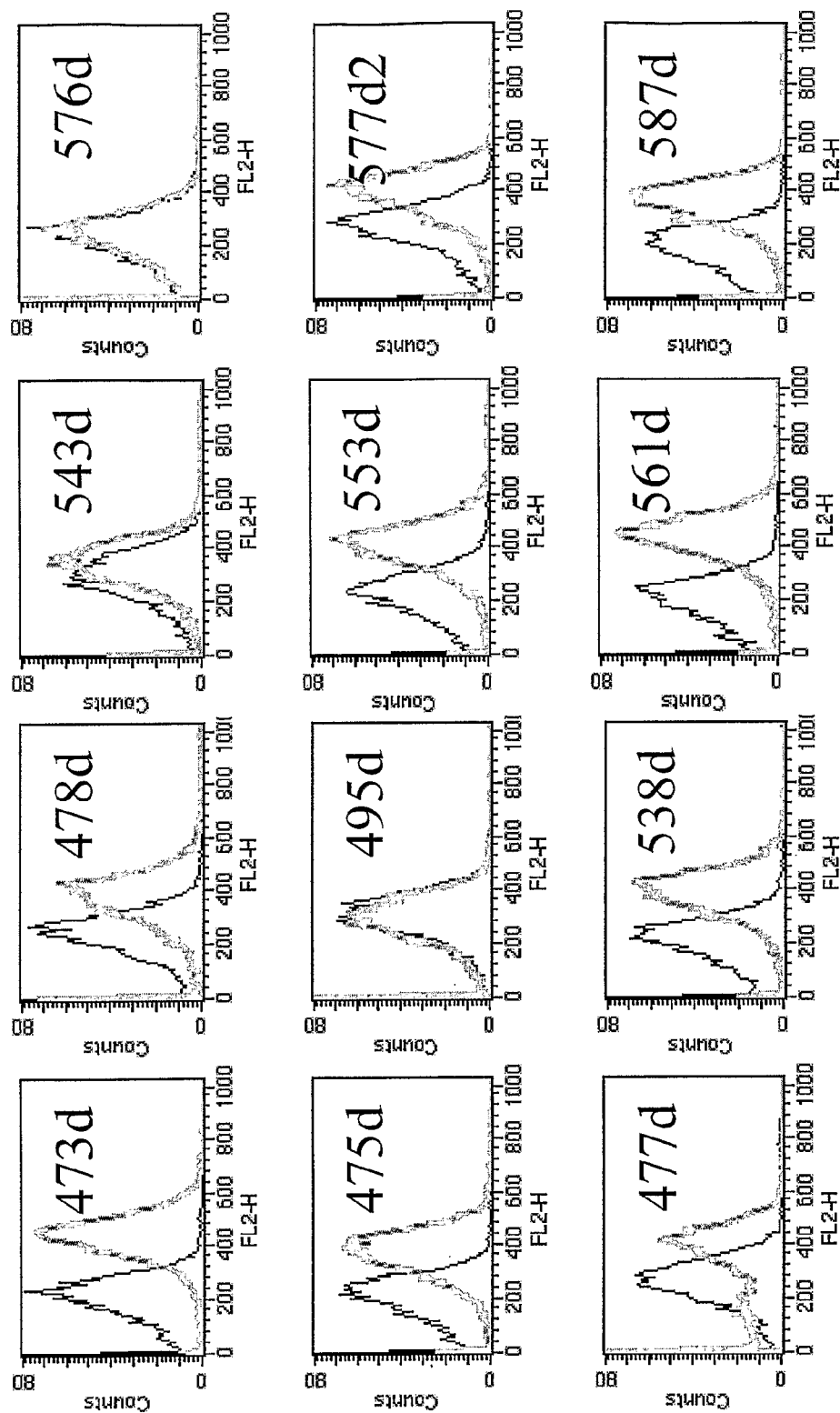
Figure 111C:
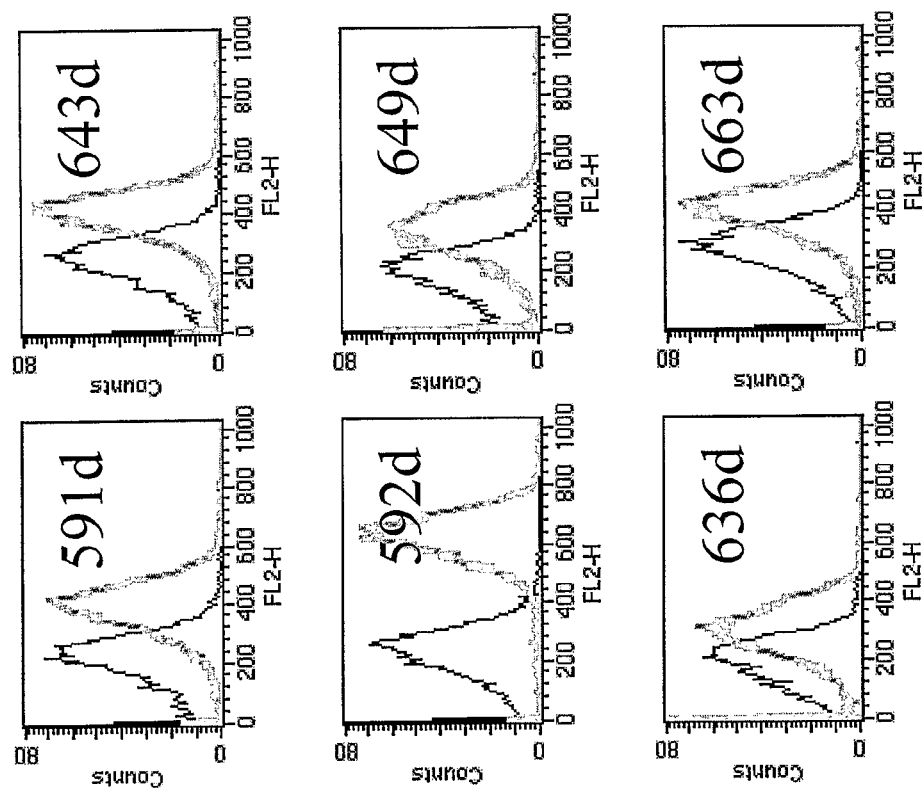

The strain was grown as described above and the capsule content was determined by measuring the amount of hyaluronic acid recovered as described below. Under these conditions, M3 produced approximately 51 fg of hyaluronic acid per cfu, three times as much as SF370 strain. See Table 10 and FIG. 108. M3 bacteria were then subjected to the same surfome analysis described above.

As shown in Table 11, only 10 proteins could be detected upon proteolytic digestion and mass spectrometry analysis; all but one (Elongation Factor Tu) were predicted to be surface-associated. They include 5 LPXTG (SEQ ID NO:931)-carrying proteins, two membrane proteins and two secreted proteins. Interestingly, 5 of these proteins belong to the hypothetical/unknown protein family. Furthermore, with the exception of the F2-like protein, whose coding gene is absent in SF370, and of the putative penicillin binding protein and the hypothetical protein SPs1270, all the other proteins also belong to the SF370 surfome.

In conclusion, the presence of capsule does interfere with surface accessibility of proteins, as judged by the reduced number of peptides which could be generated upon proteolytic digestion of whole cells.

EXAMPLE 18

Surfome Validation

The almost complete absence of cytoplasmic proteins in both surfomes suggested that our procedure was selective for surface-exposed protein identification. To further confirm the robustness of the procedure we carried out two types of analysis.

First, we subjected the 37 trans-membrane proteins of SF370 surfome to topological prediction using PSORT (see URL address http file type, www host server, domain name nibb.ac.ip, form directory) and asked whether the peptides generated by the proteolytic cleavage and identified by MS/MS were located, as it would be expected in the case of a correct topological prediction, within the external domains. As shown in FIG. 106, for 26 out of 37 membrane proteins in silico analysis and experimental MS/MS data were perfectly consistent. On the contrary, the corresponding identified peptides of the remaining 11 proteins mapped on PSORT-predicted intracellular domains.

This contradiction prompted us to manually inspect the topological and functional annotations of each of these 11 proteins. We concluded that it was desirable to revisit the predicted trans-membrane organization of at least 6 out of 11 proteins. In particular, the two peptides derived from the putative cell division protein NT01SP0014, homologous to the FtsH protein family, are located within a well conserved protein domain known to be extracellular in FtsH proteins (Tomoyasu et al., J. Bacteriol. 175, 1352-57, 1993; Akiyama et al., J. Biol. chem. 271, 22326-33, 1998; Amara et al., Microbiol. 144, 1197-1203, 1998) was found to carry a well conserved protein domain known to be extracellular in these proteins.

The four peptides of NT01SP1255, a second putative cell division protein homologous to FtsZ, are located within the C-terminal part of the molecule, a region that in Bartonella bacilliformis was found immunogenic and surface-exposed (Padmalayam et al., J. Bacteriol. 179, 4545-52, 1997).

The two hypothetical proteins NT01SP0289 and NT01SP1789 carry transmembrane regions (TMR) with a very poor PSORT score and, having a leader peptide cleavage sites next to a Cys residue, are likely to be lipoproteins rather than integral membrane proteins NT01SP0947 has two TMRs the second of which with a very poor PSORT score (−0.32 as opposed to −8.12 of the first TMR). If the second TMR were in fact not real, the C-terminal part of the molecule, which carries a typical sortase domain, would be exposed on the surface, which would be consistent with the sortases mechanism of action (Paterson & Mitchell, Trends Microbiol. 12, 89-95, 2004).

Finally, NT01SP0154, a putative glycine-betaine binding permease protein, is predicted to have 6 TMRs, one of which with a poor score. Again, if the weak TMR is neglected, the topological organization would change and the C-terminal region, where the two MS/MS identified peptides fall, would become surface-exposed. Indeed, polyclonal antibodies against the C-terminal domain of the protein efficiently bound GAS SF370 whole cells when tested by FACS.

Figure 105A:
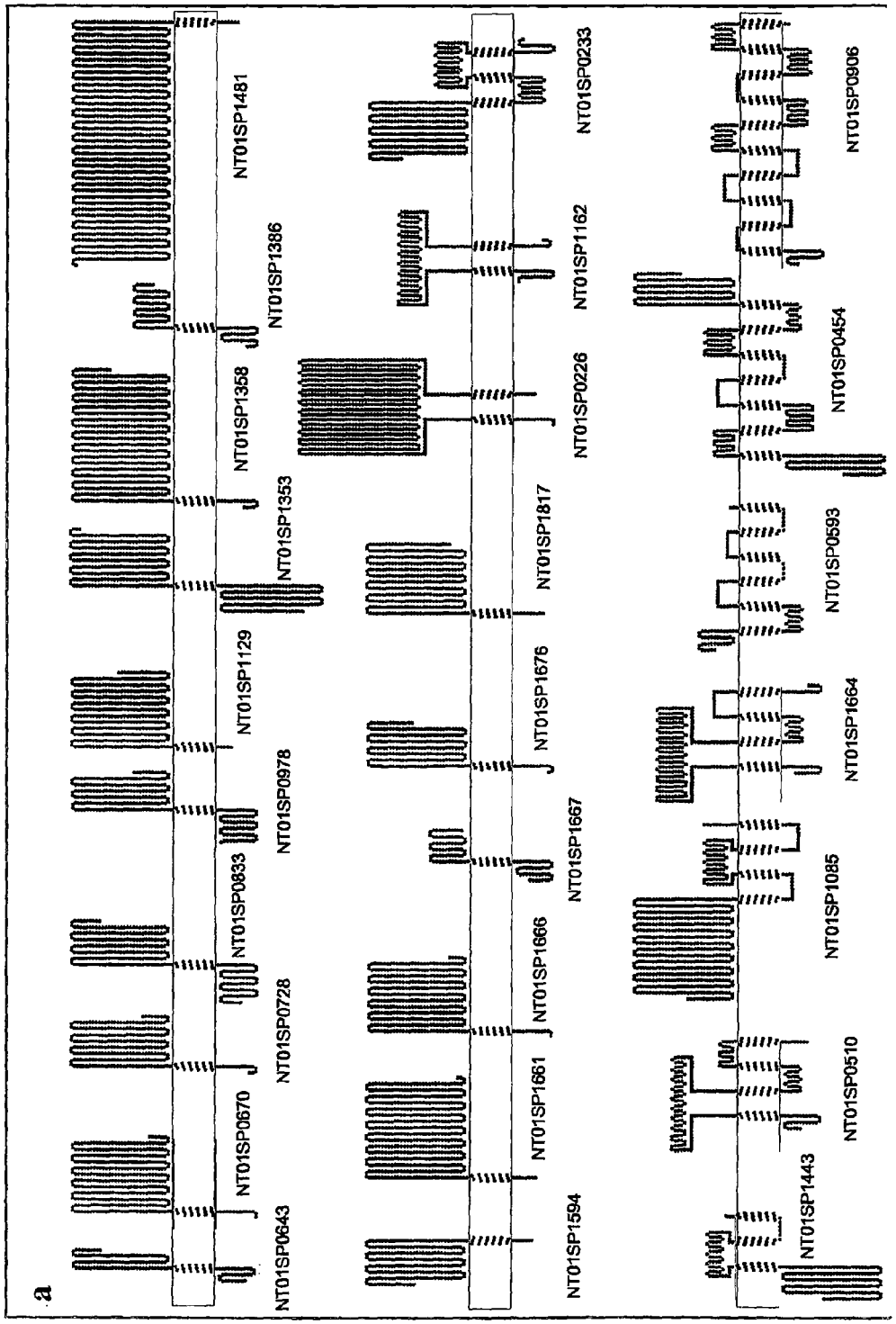
FIG. 105A-B. Bioinformatics-based topology predictions of all the predicted membrane proteins identified and their matching with identified peptides. Proteins are ordered by the number of predicted transmembrane domains (TMD) and, within, by their TIGR accession number.
Figure 105B:
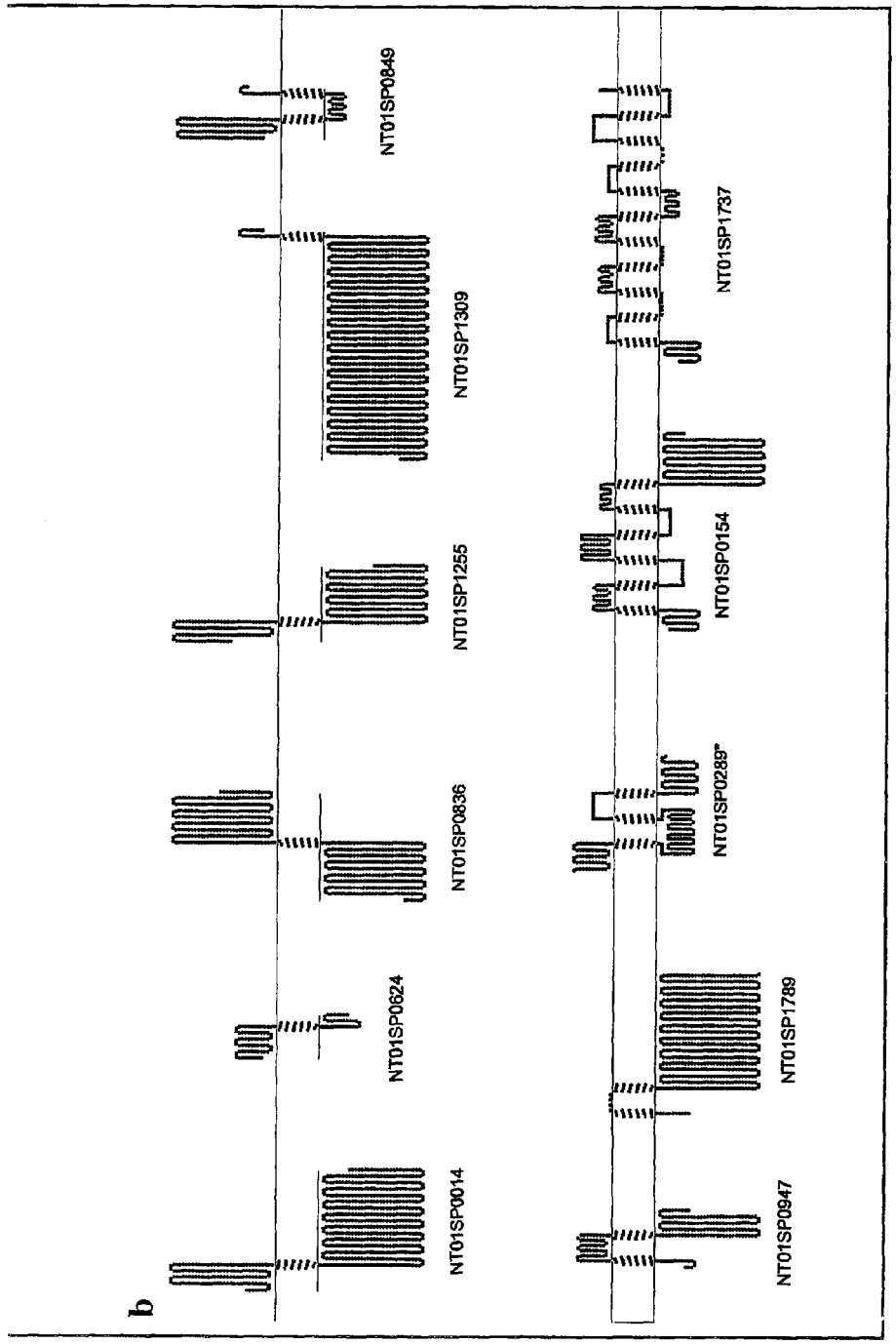

The second type of study we used to validate our surfome analysis was based on FACS analysis using protein-specific antibodies. Polyclonal antibodies were produced against 51 recombinant proteins selected among the SF370 surfome, and the antibodies were tested for their capacity to bind to whole bacteria. All but 7 sera were positive in the assay, indicating that each corresponding protein was sufficiently exposed on the bacterial surface to be accessible to antibody binding (see also Table 9). Similarly, polyclonal antibodies against 4 of the 10 proteins belonging to the M3 surfome were tested by FACS and three of them were capable of binding to M3 cells (See FIG. 105; Table 9).

From these data we concluded that our approach for surfome analysis is accurate in determining which proteins are entirely or partially exposed on bacterial cell surface.

EXAMPLE 19

Application of Surfome Analysis to Vaccine Discovery

From previous experience with Meningococcus B and Group B Streptococcus we know that for an antigen to be a vaccine candidate it is desirable that it be well expressed and exposed on the surface of the bacterial cell (Pizza et al., Science 287, 1816-20, 2000; Maione et al., Science. 2005 Jul. 1; 309(5731):148-50.). Because surfomes, by definition, include this category of proteins, surfome analysis is an ideal approach to identification of new vaccine candidates. In support of this is the observation that 6 of the 10 reported GAS protective antigens whose genes are present in SF370 are part of the SF370 surfome. See Table 12 and references cited therein.

Because several of the SF370 surfome proteins have never been tested for protection, we investigated whether some of them could elicit protective responses in the mouse model. Unfortunately, SF370 is not virulent in the mouse, the LD50 dose being over 108 CFUs. Because we expect the GAS surfome to vary somewhat from strain to strain depending upon protein expression level, capsule thickness, and gene variability, before testing the SF370 surfome proteins in protection studies against a different strain, we investigated which of these proteins were also exposed on the surface of the challenge strain.

To this end, we defined the surfome of M23 DSM2071, one of the GAS strains we routinely used for mouse challenge. Because the genome sequence of M23 DSM2071 is not available, only the exposed proteins that are in common to SF370 or to the other six GAS strains whose sequences are available in the public databases (URL address: http file type, www host server, domain names tigr.org and ncbi.nlm.nih.gov) are identified, whereas the M23 DSM2071-specific proteins remain uncharacterized.

As shown in Table 7, a total of 17 proteins were unambiguously identified: 5 cell wall anchored proteins, 4 lipoproteins, 5 membrane proteins, 2 secreted proteins and 1 cytoplasmic protein. All these proteins have an analogue in SF370 and all but two (the putative zinc-containing alcohol dehydrogenase and the putative, RofA-related, regulatory protein) were also included in the SF370 surfome (Table 9). Interestingly, most (13 out of 17) of the identified proteins belong to the family of putative/hypothetical proteins.

Of the 17 proteins belonging to the M23 DSM2071 surfome, 14 proteins were successfully expressed in E. coli as either soluble His-fusions or GST-fusions (Table 7). Proteins NT01SP0908 and NT01SP0485 were not considered for expression because they have significant homology with human proteins. Five-week-old female CD 1 mice (10 mice/group) were immunized with 20 μg recombinant protein administered intraperitoneally (i.p.) at 0, 21 and 35 days with complete Freund's adjuvant (CFA) the first time and with incomplete Freund's adjuvant (IFA) the two following times. Blood samples were collected before the first and after the third immunizations. Immunized mice were challenged intranasally (i.n.) with 106 colony forming units (CFUs) of DSM 2071 strain grown in THY broth at $OD_{600}$=0.4. CFU titer of the infecting dose was verified by plating on 5 THY/blood plates. Mice were monitored daily, and the final survival rate was calculated after 10 days.

As shown in Table 14, two proteins were protective in this model: the M protein (90% survival rate) and NT01SP0336 (70% survival rate). NT01SP0336, which corresponds to GAS57 in the SF370 serotype, is a putative cell envelope proteinase carrying a typical cell anchoring LPXTG (SEQ ID NO:931) motif.

Interestingly, GAS57 provided little or no protection in a mouse model in which intraperitoneal immunization was followed by intraperitoneal challenge. GAS40 was protective in both models, even though the survival rate in the intranasal challenge model was higher.

EXAMPLE 20

Capsule Hyaluronic Acid Content Determination

Cells from a 10-ml exponential-phase culture (OD600=0.4) are washed twice with water and then resuspended in 500 μl of water. Capsule is released by shaking with 1 ml of clorophorm. After clarifying the sample by centrifugation, the hyaluronic acid content of 50 μl of the aqueous phase is determined by measuring absorbance at 640 nm after adding to the sample 1 ml of a solution containing 20 mg of Stains-All product (Sigma Chemical Co.) and 60 µl of glacial acetic acid in 100 ml of 50% formamide. Absorbance values are compared with a standard curve generated using known concentrations of hyaluronic acid.

EXAMPLE 21

Identification of Surface Exposed Domains of GAS Antigens

In silico prediction algorithms initially identified 684 genes encoding for products likely to be secreted or associated with the bacterial surface. See Pizza et al., Science 287, 1816-20, 2000; Tettelin et al., Proc. Natl. Acad. Sci. U.S.A. 99, 12391-96, 2002. Of these, 207 were predicted to contain more than two transmembrane spanning regions. The protein sequences were searched for isolated domains of at least 50 amino acids which were predicted to lay on the surface of the cell (e.g., extracellular loops, amino-terminal, or carboxy-terminal domains). Surface exposure was assessed with the aid of the on-line web server TMPRED (see URL address: http file type, www host server, domain name.ch.embnet.org, software/TMPRED_form.directory), which is able to predict membrane-spanning regions and their orientation using an algorithm based on the statistical analysis of TMbase, a database of naturally occurring transmembrane proteins.

Each of the identified domains was cloned in parallel in two vectors containing either sequences coding for 6 histidine residues. Recombinant products were successfully expressed and purified from E. coli.

EXAMPLE 22

Immunization with Surface-Exposed GAS Antigens

Groups of 10 or more CD1 female mice aged between 6 and 7 weeks were immunized with 20 µg of a recombinantly produced surface-exposed GAS antigen suspended in 100 µl of suitable solution. Mice of each group received 3 doses, at days 0, 21 and 45. Immunization was performed through intraperitoneal injection of the protein with an equal volume of Complete Freund's Adjuvant (CFA) for the first dose and with Incomplete Freund's Adjuvant (IFA) for the following two doses. Negative and positive control groups were used in each immunization scheme.

Mice in the negative control group were immunized with E. coli proteins eluted from the purification columns following processing of total bacterial extract from an E. coli strain containing either the pET21b or the pGEX-NNH vector (thus expressing GST only) without any cloned GAS ORF (indicated as HisStop or GSTStop, respectively).

Mice in the positive control groups were immunized with purified GAS M cloned from either GAS SF370 or GAS DSM 2071 strains (groups indicated as 192SF and 192DSM respectively).

Serum from each mouse was collected before the first immunization and two weeks after the last immunization. The sera of mice in each group were pooled. Mice were infected with one of GAS strains 2071 (M23), 3348 (M1), or 2728 (M12) about a week after the last immunization. For infection, GAS strains were grown at 37° C. in THY broth until OD600 0.4. Bacteria were collected by centrifugation, washed once with PBS, suspended, and diluted with PBS to obtain the appropriate concentration of bacteria/ml and administered to mice by intraperitoneal injection. Between 50 and 100 bacteria were given to each mouse, as determined by plating aliquots of the bacterial suspension on 5 THY plates. Animals were observed daily and checked for survival.

The results are shown in FIGS. 109A-111C and summarized in Table 15. A delta mean of >80 indicates that the tested domain is surface-exposed.

The results demonstrate that each of the tested domains—GAS35, GAS414, GAS426, GAS433, GAS434, GAS437, GAS438, GAS439, GAS461, GAS465-2, GAS469, GAS472, GAS473, GAS475, GAS477, GAS478, GAS495, GAS538, GAS543, GAS553, GAS561, GAS576, GAS577-2, GAS587, GAS591, GAS593, GAS636, GAS643, GAS649, and GAS663—is exposed on the surface of at least one of the three GAS strains tested. Some of the tested domains show a variable delta mean across the strains used (M1, M23 and M12), possibly because of the different "visibility" of these domains due to capsule masking (for instance M23 is a highly encapsulated strain). Domains GAS35, GAS414, GAS437, GAS438, GAS461, GAS465-2, GAS469, GAS472, GAS473, GAS475, GAS478, GAS495, GAS538, GAS553, GAS561, GAS577-2, GAS591, GAS593, GAS636, GAS643, GAS649, and GAS663 are surface-exposed on the surface of at least two of the three GAS strains tested. Domains GAS472, GAS473, and GAS553 are surface-exposed on all three of the tested GAS strains.

EXAMPLE 23

Protein Microarray Experiments

Protein chips allow for the identification of clinical immunogenic prevalence of pathogenic proteins in human sera. Using protein chips we tested serum samples from 6 healthy donors, two of which had had a recent documented pharyngitis associated to GAS infection (SC and TM, see FIG. 112).

Figure 112:
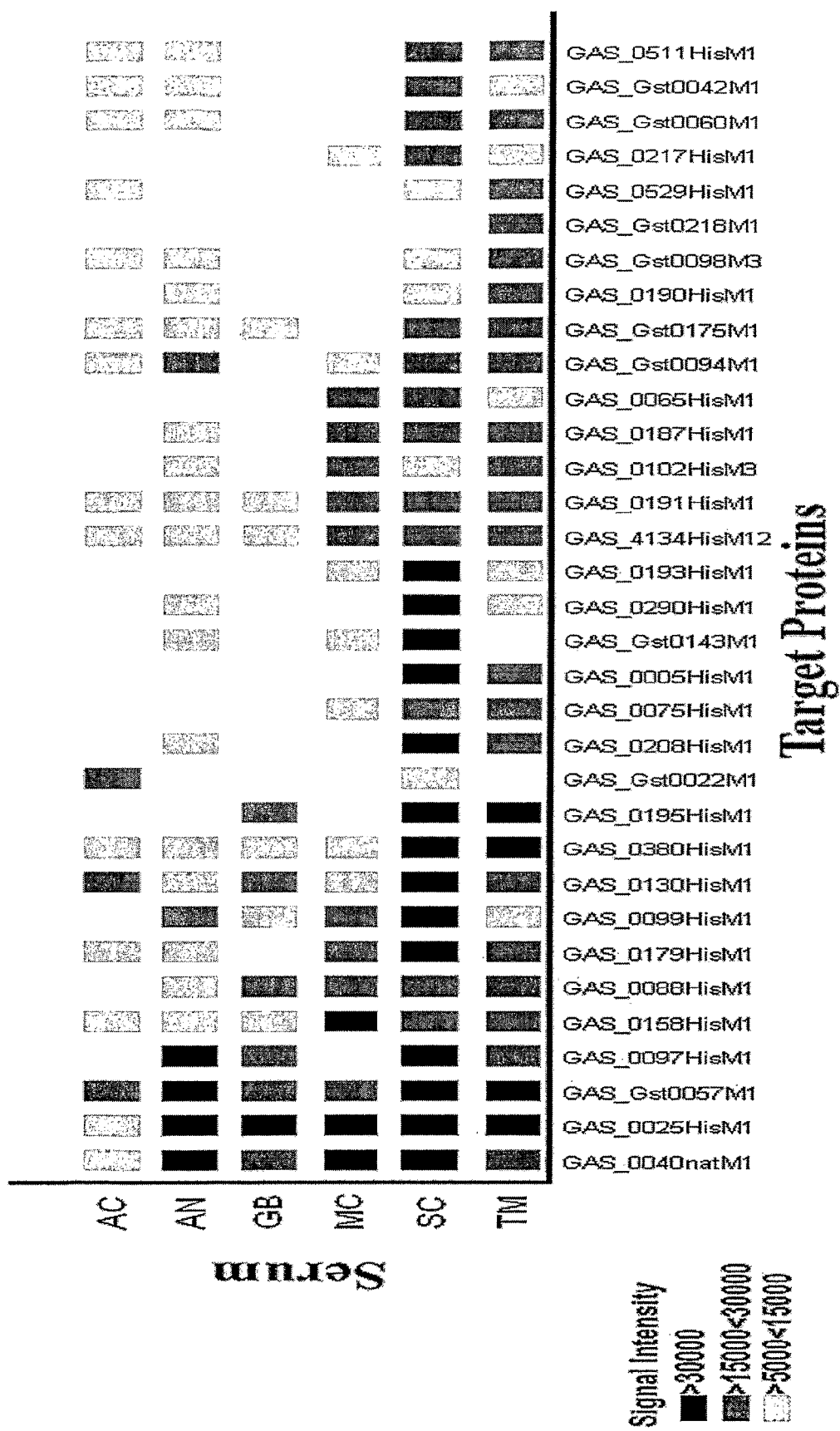
FIG. 112. Graph showing prevalent immunoreactive antigens identified from serum samples of 6 healthy donors.

FIG. 112 shows a diagram where the prevalent immunoreactive antigens are mapped and clustered according to signal intensity and response frequency for each of the 6 donors.

Experimental Procedure

112 GAS proteins (19 GST fusions, 91 His-tagged and 2 native proteins) were purified, diluted in PBS at a concentration of 0.5 mg/ml and dispensed (6 µl each) in 384 well polypropylene micro plates. Four replicates of the protein solutions were spotted on nitrocellulose coated Fast Slides chips (Schleier & Schuell) using the VERSARRAY CHIPWRITER Pro System (BIO-RAD) equipped with TeleChem quill pins (TeleChem International Sunnyvale, Calif., USA). Following the first printing of each protein, the pins were washed 7 times (6 seconds each), subjected to sonication (1 second) and dried under vacuum (2 seconds). Each chip contains at least one immunoglobulin and two BSA (Cy3 and Cy5-labelled, Amersham Biosciences) standard curves. After each printing process, each slide was scanned to check the signals of the Cy3 and Cy5-labeled BSA curves.

Slides were pre-incubated overnight at 4° C. in the dark with agitation in 3% Top Block (Fluka-BioChemiKa, Cat. no 37766) and 0.1% TPBS (0.1% Tween 20 in PBS). Slides were then incubated with human sera (1:1000 final dilution) for 1 hr at room temperature in the dark and were then washed 3 times (5 minutes each time) in 0.1% TPBS. Cy3 or Cy5 anti-human IgG (1:800), IgA or IgM (1:1000) were added and incubation was prolonged for 1 hr at room temperature in the dark.

Slides were washed two times with TPBS (5 minutes each time), once with PBS (10 minutes), once with milliQ sterile water (30 seconds) and were then dried either at 37° C. for 10-20 minutes in the dark or using a nitrogen stream.

Fluorescence signals were detected with a ScanArray 5000 Unit (Packard, Billerica, Mass., USA) at high resolution (10 µm pixel size) and quantified with the ImaGene 6.0 software (Biodiscovery Inc, Ca, Usa)

Elaboration of the collected data was performed using software which normalizes the data by interpolating the least-mean squares of the Ig controls to a sigmoid curve. The titer value corresponding to each experimental intensity signal is then referred to such sigmoid and normalized to a theoretic sigmoid curve extending over the whole dynamic range of the scanner.

TABLE 1

Sequence identifiers

| GAS | annotation | SEQUENCE IDENTIFIER amino acid | nucleotide |
|---|---|---|---|
| 4 | full-length | 1 | 650 |
| 5 | full-length | 2 | 651 |
| 6 | full-length | 3 | 652 |
| 10 | full-length | 4 | 653 |
| 15 | full-length | 5 | 654 |
| 16 | full-length | 6 | 655 |
| 18 | full-length | 7 | 656 |
| 22 | full-length | 8 | 657 |
| 23 | full-length | 9 | 658 |
| 24 | full-length | 10 | 659 |
| 25 | full-length | 11 | 660 |
| 29 | full-length | 12 | 661 |
| 30 | full-length | 13 | 662 |
| 35 | full-length | 14 | 663 |
| 36 | full-length | 15 | 664 |
| 39 | full-length | 16 | 665 |
| 40 | strains SF370, 3280, 3348, 2913, 3789, 2580 | 17 | 666 (3280); 667 (3348); 668 (2913); 669 (3789); 670 (2580) |
| 40 | 2634 | 18 | 675 |
| 40 | 2726 | 19 | 676 |
| 40 | 2721 | 20 | 677 |
| 40 | 3040, 3135 | 21 | 671 (3135); 678 (3040) |
| 40 | 2722 | 22 | 679 |
| 40 | 2728 | 23 | 680 |
| 40 | 4883 | 24 | 681 |
| 40 | 2724 | 25 | 682 |
| 40 | 2894, 3650, 5529, 3776 | 26 | 672 (3650); 673 (5529); 674 (3776); 683 (2894); |
| 40 | 2720 | 27 | 684 |
| 40 | 2725 | 28 | 685 |
| 40 | 4538 | 29 | 686 |
| 40 | 5531 | 30 | 687 |
| 40 | 5481 | 31 | 688 |
| 40 | 4959 | 32 | 689 |
| | type | | |
| 40 | DSM2071 | 33 | 690 |
| 40 | 4436 | 34 | 691 |
| 40 | 2727 | 35 | 692 |
| 40 | 2719 | 36 | 693 |
| 40 | 5455 | 37 | 694 |
| 40 | 5476 | 38 | 695 |
| 40 | 4088 | 39 | 696 |
| 40 | MANFR10394 | 40 | 697 |
| 40 | M8232 | 41 | 698 |
| 40 | M315 | 42 | 699 |
| 40 | SS1 | 43 | 700 |
| 41 | full-length | 44 | 701 |
| 42 | full-length | 45 | 702 |
| 45 | full-length | 46 | 703 |
| 49 | full-length | 47 | 704 |

TABLE 1-continued

Sequence identifiers

| GAS | | SEQUENCE IDENTIFIER amino acid | nucleotide |
|---|---|---|---|
| 54 | full-length | 48 | 705 |
| 56 | full-length | 49 | 706 |
| 57 | full-length | 50 | 707 |
| 58 | full-length | 51 | 708 |
| 60 | full-length | 52 | 709 |
| 62 | full-length | 53 | 710 |
| 63 | full-length | 54 | 711 |
| 64 | full-length | 55 | 712 |
| 65 | full-length | 56 | 713 |
| 67 | full-length | 57 | 714 |
| 68 | full-length | 58 | 715 |
| 69 | full-length | 59 | 716 |
| 70 | full-length | 60 | 717 |
| 72 | full-length | 61 | 718 |
| 74 | full-length | 62 | 719 |
| 75 | full-length | 63 | 720 |
| 76 | full-length | 64 | 721 |
| 77 | full-length | 65 | 722 |
| 78 | full-length | 66 | 723 |
| 81 | full-length | 67 | 724 |
| 82 | full-length | 68 | 725 |
| 83 | full-length | 69 | 726 |
| 84 | full-length | 70 | 727 |
| 85 | full-length | 71 | 728 |
| 86 | full-length | 72 | 729 |
| 87 | full-length | 73 | 730 |
| 88 | full-length | 74 | 731 |
| 89 | full-length | 75 | 732 |
| 91 | full-length | 76 | 733 |
| 92 | full-length | 77 | 734 |
| 93 | full-length | 78 | 735 |
| 94 | full-length | 79 | 736 |
| 95 | full-length | 80 | 737 |
| 96 | full-length | 81 | 738 |
| 97 | full-length | 82 | 739 |
| 98 | full-length | 83 | 740 |
| 99 | full-length | 84 | 741 |
| 100 | full-length | 85 | 742 |
| 101 | full-length | 86 | 743 |
| 102 | full-length | 87 | 744 |
| 103 | full-length | 88 | 745 |
| 104 | full-length | 89 | 746 |
| 105 | full-length | 90 | 747 |
| 108 | full-length | 91 | 748 |
| 117 | full-length | 92 | 749 |
| 123 | full-length | 93 | 750 |
| 130 | full-length | 94 | 751 |
| 131 | full-length | 95 | 752 |
| 137 | full-length | 96 | 753 |
| 142 | full-length | 97 | 754 |
| 143 | full-length | 98 | 755 |
| 149 | full-length | 99 | 756 |
| 152 | full-length | 100 | 757 |
| 157 | full-length | 101 | 758 |
| 158 | full-length | 102 | 759 |
| 159 | full-length | 103 | 760 |
| 160 | full-length | 104 | 761 |
| 163 | full-length | 105 | 762 |
| 165 | full-length | 106 | 763 |
| 166 | full-length | 107 | 764 |
| 168 | full-length | 108 | 765 |
| 171 | full-length | 109 | 766 |
| 175 | full-length | 110 | 767 |
| 177 | full-length | 111 | 768 |
| 178 | full-length | 112 | 769 |
| 179 | full-length | 113 | 770 |
| 183 | full-length | 114 | 771 |
| 187 | full-length | 115 | 772 |
| 188 | full-length | 116 | 773 |
| 190 | full-length | 117 | 774 |
| 191 | full-length | 118 | 775 |
| 192 | full-length | 119 | 776 |
| 193 | full-length | 120 | 777 |

TABLE 1-continued

Sequence identifiers

| GAS | SEQUENCE IDENTIFIER amino acid | nucleotide |
|---|---|---|
| 194 | full-length | 121 | 778 |
| 195 | full-length | 122 | 779 |
| 198 | full-length | 123 | 780 |
| 201 | full-length | 124 | 781 |
| 202 | full-length | 125 | 782 |
| 205 | full-length | 126 | 783 |
| 206 | full-length | 127 | 784 |
| 207 | full-length | 128 | 785 |
| 208 | full-length | 129 | 786 |
| 210 | full-length | 130 | 787 |
| 217 | full-length | 131 | 788 |
| 218 | full-length | 132 | 789 |
| 219 | full-length | 133 | 790 |
| 220 | full-length | 134 | 791 |
| 224 | full-length | 135 | 792 |
| 236 | full-length | 136 | 793 |
| 242 | full-length | 137 | 794 |
| 249 | full-length | 138 | 795 |
| 251 | full-length | 139 | 796 |
| 253 | full-length | 140 | 797 |
| 259 | full-length | 141 | 798 |
| 262 | full-length | 142 | 799 |
| 264 | full-length | 143 | 800 |
| 268 | full-length | 144 | 801 |
| 271 | full-length | 145 | 802 |
| 277 | full-length | 146 | 803 |
| 282 | full-length | 147 | 804 |
| 284 | full-length | 148 | 805 |
| 286 | full-length | 149 | 806 |
| 290 | full-length | 150 | 807 |
| 291 | full-length | 151 | 808 |
| 292 | full-length | 152 | 809 |
| 294 | full-length | 153 | 810 |
| 299 | full-length | 154 | 811 |
| 309 | full-length | 155 | 812 |
| 327 | full-length | 156 | 813 |
| 366 | full-length | 157 | 814 |
| 372 | full-length | 158 | 815 |
| 380 | full-length | 159 | 816 |
| 382 | full-length | 160 | 817 |
| 362-1 | full-length | 161 | 818 |
| 384 | full-length | 162 | 819 |
| 389 | full-length | 163 | 820 |
| 396 | full-length | 164 | 821 |
| 405 | full-length | 165 | 822 |
| 406 | full-length | 166 | 823 |
| 414 | full-length | 167 | 824 |
| 421 | full-length | 168 | 825 |
| 425 | full-length | 169 | 826 |
| 426 | full-length | 170 | 827 |
| 428 | full-length | 171 | 828 |
| 433 | full-length | 172 | 829 |
| 434 | full-length | 173 | 830 |
| 437 | full-length | 174 | 831 |
| 438 | full-length | 175 | 832 |
| 439 | full-length | 176 | 833 |
| 457 | full-length | 177 | 834 |
| 460 | full-length | 178 | 835 |
| 461 | full-length | 179 | 836 |
| 465 | full-length | 180 | 837 |
| 469 | full-length | 181 | 838 |
| 472 | full-length | 182 | 839 |
| 473 | full-length | 183 | 840 |
| 474 | full-length | 184 | 841 |
| 475 | full-length | 185 | 842 |
| 477 | full-length | 186 | 843 |
| 478 | full-length | 187 | 844 |
| 486 | full-length | 188 | 845 |
| 492 | full-length | 189 | 846 |
| 493 | full-length | 190 | 847 |
| 494 | full-length | 191 | 848 |
| 495 | full-length | 192 | 849 |
| 500 | full-length | 193 | 850 |
| 504 | full-length | 194 | 851 |
| 509 | full-length | 195 | 852 |
| 511 | full-length | 196 | 853 |
| 527 | full-length | 197 | 854 |
| 529 | full-length | 198 | 855 |
| 533 | full-length | 199 | 856 |
| 535 | full-length | 200 | 857 |
| 538 | full-length | 201 | 858 |
| 540 | full-length | 202 | 859 |
| 543 | full-length | 203 | 860 |
| 545 | full-length | 204 | 861 |
| 553 | full-length | 205 | 862 |
| 558 | full-length | 206 | 863 |
| 560 | full-length | 207 | 864 |
| 561 | full-length | 208 | 865 |
| 564 | full-length | 209 | 866 |
| 565 | full-length | 210 | 867 |
| 574 | full-length | 211 | 868 |
| 576 | full-length | 212 | 869 |
| 577 | full-length | 213 | 870 |
| 579 | full-length | 214 | 871 |
| 586 | full-length | 215 | 872 |
| 587 | full-length | 216 | 873 |
| 591 | full-length | 217 | 874 |
| 592 | full-length | 218 | 875 |
| 607 | full-length | 219 | 876 |
| 609 | full-length | 220 | 877 |
| 625 | full-length | 221 | 878 |
| 626 | full-length | 222 | 879 |
| 636 | full-length | 223 | 880 |
| 640 | full-length | 224 | 881 |
| 643 | full-length | 225 | 882 |
| 645 | full-length | 226 | 883 |
| 649 | full-length | 227 | 884 |
| 650 | full-length | 228 | 885 |
| 653 | full-length | 229 | 886 |
| 657 | full-length | 230 | 887 |
| 663 | full-length | 231 | 888 |
| 685 | full-length | 232 | 889 |
| 117/40 | full-length | 233 | 890 |
| 40/117 | full-length | 234 | 891 |
| 40a-HIS | full-length | 235 | 892 |
| (place holder) | | 236 | |
| 40aRR-HIS | full-length | 237 | 893 |
| spy0047 | full-length | 238 | 894 |
| spy0053 | full-length | 239 | 895 |
| spy0056 | full-length | 240 | 896 |
| spy0063 | full-length | 241 | 897 |
| spy0069 | full-length | 242 | 898 |
| spy0080a | full-length | 243 | 899 |
| spy0098 | full-length | 244 | 900 |
| spy0127 | full-length | 245 | 901 |
| spy0272 | full-length | 246 | 902 |
| spy0461 | full-length | 247 | 903 |
| spy0611 | full-length | 248 | 904 |
| spy0666 | full-length | 249 | 905 |
| spy0686 | full-length | 250 | 906 |
| spy0688 | full-length | 251 | 907 |
| spy0717 | full-length | 252 | 908 |
| spy0792 | full-length | 253 | 909 |
| spy080a | full-length | 254 | 910 |
| spy0913 | full-length | 255 | 911 |
| spy1029 | full-length | 256 | 912 |
| spy1073 | full-length | 257 | 913 |
| spy1085 | full-length | 258 | 914 |
| spy1200 | full-length | 259 | 915 |
| spy1260 | full-length | 260 | 916 |
| spy1281 | full-length | 261 | 917 |
| spy1613 | full-length | 262 | 918 |
| spy1721 | full-length | 263 | 919 |
| spy1750 | full-length | 264 | 920 |
| spy1805 | full-length | 265 | 921 |
| spy1835 | full-length | 266 | 922 |

TABLE 1-continued

Sequence identifiers

| GAS | | SEQUENCE IDENTIFIER | |
|---|---|---|---|
| | | amino acid | nucleotide |
| spy2005 | full-length | 267 | 923 |
| spy2070 | full-length | 268 | 924 |
| spy2092 | full-length | 269 | 925 |
| spy2093 | full-length | 270 | 926 |
| spy2178 | full-length | 271 | 927 |
| g-21909751 | full-length | 272 | 928 |
| NT01SP0246 | full-length | 273 | 929 |
| M | full-length | 274 | |
| SagA | full-length | 275 | |
| Sfb1 | full-length | 276 | |
| Shp | full-length | 277 | |
| linker | full-length | 278 | |
| linker | full-length | 279 | |
| linker | full-length | 280 | |
| 40a-HIS | full-length | 281 | |
| 4 | fragment | 282 | |
| 4 | fragment | 283 | |
| 5 | fragment | 284 | |
| 5 | fragment | 285 | |
| 15 | fragment | 286 | |
| 15 | fragment | 287 | |
| 16 | fragment | 288 | |
| 23 | fragment | 289 | |
| 23 | fragment | 290 | |
| 24 | fragment | 291 | |
| 24 | fragment | 292 | |
| 24 | fragment | 293 | |
| 24 | fragment | 294 | |
| 24 | fragment | 295 | |
| 25 | fragment | 296 | |
| 25 | fragment | 297 | |
| 40 | fragment | 298 | |
| 54 | fragment | 299 | |
| 57 | fragment | 300 | |
| 57 | fragment | 301 | |
| 57 | fragment | 302 | |
| 63 | fragment | 303 | |
| 64 | fragment | 304 | |
| 64 | fragment | 305 | |
| 64 | fragment | 306 | |
| 64 | fragment | 307 | |
| 64 | fragment | 308 | |
| 64 | fragment | 309 | |
| 68 | fragment | 310 | |
| 72 | fragment | 311 | |
| 72 | fragment | 312 | |
| 84 | fragment | 313 | |
| 84 | fragment | 314 | |
| 84 | fragment | 315 | |
| 86 | fragment | 316 | |
| 86 | fragment | 317 | |
| 86 | fragment | 318 | |
| 86 | fragment | 319 | |
| 86 | fragment | 320 | |
| 87 | fragment | 321 | |
| 89 | fragment | 322 | |
| 89 | fragment | 323 | |
| 89 | fragment | 324 | |
| 98 | fragment | 325 | |
| 98 | fragment | 326 | |
| 98 | fragment | 327 | |
| 98 | fragment | 328 | |
| 98 | fragment | 329 | |
| 102 | fragment | 330 | |
| 103 | fragment | 331 | |
| 108 | fragment | 332 | |
| 143 | fragment | 333 | |
| 143 | fragment | 334 | |
| 143 | fragment | 335 | |
| 143 | fragment | 336 | |
| 149 | fragment | 337 | |
| 152 | fragment | 338 | |
| 157 | fragment | 339 | |
| 157 | fragment | 340 | |
| 157 | fragment | 341 | |
| 157 | fragment | 342 | |
| 157 | fragment | 343 | |
| 157 | fragment | 344 | |
| 157 | fragment | 345 | |
| 157 | fragment | 346 | |
| 157 | fragment | 347 | |
| 157 | fragment | 348 | |
| 157 | fragment | 349 | |
| 157 | fragment | 350 | |
| 158 | fragment | 351 | |
| 163 | fragment | 352 | |
| 163 | fragment | 353 | |
| 163 | fragment | 354 | |
| 163 | fragment | 355 | |
| 166 | fragment | 356 | |
| 166 | fragment | 357 | |
| 168 | fragment | 358 | |
| 177 | fragment | 359 | |
| 188 | fragment | 360 | |
| 188 | fragment | 361 | |
| 188 | fragment | 362 | |
| 188 | fragment | 363 | |
| 190 | fragment | 364 | |
| 190 | fragment | 365 | |
| 190 | fragment | 366 | |
| 190 | fragment | 367 | |
| 190 | fragment | 368 | |
| 190 | fragment | 369 | |
| 190 | fragment | 370 | |
| 190 | fragment | 371 | |
| 190 | fragment | 372 | |
| 190 | fragment | 373 | |
| 190 | fragment | 374 | |
| 190 | fragment | 375 | |
| 190 | fragment | 376 | |
| 190 | fragment | 377 | |
| 190 | fragment | 378 | |
| 190 | fragment | 379 | |
| 190 | fragment | 380 | |
| 190 | fragment | 381 | |
| 190 | fragment | 382 | |
| 190 | fragment | 383 | |
| 190 | fragment | 384 | |
| 190 | fragment | 385 | |
| 190 | fragment | 386 | |
| 190 | fragment | 387 | |
| 190 | fragment | 388 | |
| 190 | fragment | 389 | |
| 190 | fragment | 390 | |
| 190 | fragment | 391 | |
| 190 | fragment | 392 | |
| 190 | fragment | 393 | |
| 190 | fragment | 394 | |
| 190 | fragment | 395 | |
| 190 | fragment | 396 | |
| 190 | fragment | 397 | |
| 190 | fragment | 398 | |
| 190 | fragment | 399 | |
| 190 | fragment | 400 | |
| 190 | fragment | 401 | |
| 190 | fragment | 402 | |
| 190 | fragment | 403 | |
| 190 | fragment | 404 | |
| 190 | fragment | 405 | |
| 190 | fragment | 406 | |
| 190 | fragment | 407 | |
| 190 | fragment | 408 | |
| 190 | fragment | 409 | |
| 190 | fragment | 410 | |
| 190 | fragment | 411 | |
| 191 | fragment | 412 | |

TABLE 1-continued

Sequence identifiers

| GAS | SEQUENCE IDENTIFIER | |
|---|---|---|
| | amino acid | nucleotide |
| 191 | fragment | 413 |
| 191 | fragment | 414 |
| 191 | fragment | 415 |
| 191 | fragment | 416 |
| 191 | fragment | 417 |
| 191 | fragment | 418 |
| 191 | fragment | 419 |
| 191 | fragment | 420 |
| 191 | fragment | 421 |
| 191 | fragment | 422 |
| 191 | fragment | 423 |
| 191 | fragment | 424 |
| 191 | fragment | 425 |
| 191 | fragment | 426 |
| 191 | fragment | 427 |
| 191 | fragment | 428 |
| 191 | fragment | 429 |
| 192 | fragment | 430 |
| 192 | fragment | 431 |
| 192 | fragment | 432 |
| 192 | fragment | 433 |
| 192 | fragment | 434 |
| 192 | fragment | 435 |
| 192 | fragment | 436 |
| 192 | fragment | 437 |
| 192 | fragment | 438 |
| 192 | fragment | 439 |
| 192 | fragment | 440 |
| 192 | fragment | 441 |
| 192 | fragment | 442 |
| 192 | fragment | 443 |
| 192 | fragment | 444 |
| 192 | fragment | 445 |
| 192 | fragment | 446 |
| 192 | fragment | 447 |
| 192 | fragment | 448 |
| 192 | fragment | 449 |
| 192 | fragment | 450 |
| 192 | fragment | 451 |
| 192 | fragment | 452 |
| 192 | fragment | 453 |
| 192 | fragment | 454 |
| 192 | fragment | 455 |
| 192 | fragment | 456 |
| 192 | fragment | 457 |
| 192 | fragment | 458 |
| 192 | fragment | 459 |
| 192 | fragment | 460 |
| 192 | fragment | 461 |
| 192 | fragment | 462 |
| 192 | fragment | 463 |
| 193 | fragment | 464 |
| 194 | fragment | 465 |
| 195 | fragment | 466 |
| 201 | fragment | 467 |
| 201 | fragment | 468 |
| 201 | fragment | 469 |
| 201 | fragment | 470 |
| 224 | fragment | 471 |
| 251 | fragment | 472 |
| 264 | fragment | 473 |
| 264 | fragment | 474 |
| 268 | fragment | 475 |
| 268 | fragment | 476 |
| 277 | fragment | 477 |
| 282 | fragment | 478 |
| 282 | fragment | 479 |
| 282 | fragment | 480 |
| 382 | fragment | 481 |
| 405 | fragment | 482 |
| 405 | fragment | 483 |
| 405 | fragment | 484 |
| 425 | fragment | 485 |
| 425 | fragment | 486 |
| 433 | fragment | 487 |
| 460 | fragment | 488 |
| 493 | fragment | 489 |
| 500 | fragment | 490 |
| 558 | fragment | 491 |
| 587 | fragment | 492 |
| 587 | fragment | 493 |
| 587 | fragment | 494 |
| 587 | fragment | 495 |
| 645 | fragment | 496 |
| 645 | fragment | 497 |
| 650 | fragment | 498 |
| 685 | fragment | 499 |
| NT01SP0246 (45) | fragment | 500 |
| NT01SP0246 (45) | fragment | 501 |
| NT01SP0246 (45) | fragment | 502 |
| NT01SP0246 (45) | fragment | 503 |
| Spy0047 | fragment | 504 |
| SPy0080a | fragment | 505 |
| spy0127 | fragment | 506 |
| Spy0272 | fragment | 507 |
| Spy0461 | fragment | 508 |
| Spy0611 | fragment | 509 |
| Spy0611 | fragment | 510 |
| Spy0611 | fragment | 511 |
| Spy0611 | fragment | 512 |
| Spy0611 | fragment | 513 |
| SPy0645 | fragment | 514 |
| Spy0686 | fragment | 515 |
| Spy0717 | fragment | 516 |
| Spy1073 | fragment | 517 |
| Spy1029 | fragment | 518 |
| SPy1260 | fragment | 519 |
| Spy1613 | fragment | 520 |
| Spy1835 | fragment | 521 |
| Spy1835 | fragment | 522 |
| Spy2005 | fragment | 523 |
| Spy2005 | fragment | 524 |
| Spy2093 | fragment | 525 |
| Spy2093 | fragment | 526 |
| SPy2178 | fragment | 527 |
| 24 | fragment | 528 |
| 49 | fragment | 529 |
| 57 | fragment | 530 |
| 57 | fragment | 531 |
| 64 | fragment | 532 |
| 64 | fragment | 533 |
| 64 | fragment | 534 |
| 84 | fragment | 535 |
| 98 | fragment | 536 |
| 98 | fragment | 537 |
| 98 | fragment | 538 |
| 143 | fragment | 539 |
| 143 | fragment | 540 |
| 143 | fragment | 541 |
| 149 | fragment | 542 |
| 171 | fragment | 543 |
| 188 | fragment | 544 |
| 190 | fragment | 545 |
| 191 | fragment | 546 |
| 191 | fragment | 547 |
| 191 | fragment | 548 |
| 191 | fragment | 549 |
| 191 | fragment | 550 |
| 192 | fragment | 551 |
| 192 | fragment | 552 |
| 192 | fragment | 553 |
| 192 | fragment | 554 |
| 198 | fragment | 555 |
| 201 | fragment | 556 |
| 201 | fragment | 557 |
| 251 | fragment | 558 |

TABLE 1-continued

Sequence identifiers

| GAS | | SEQUENCE IDENTIFIER | |
|---|---|---|---|
| | | amino acid | nucleotide |
| 251 | fragment | 559 | |
| 251 | fragment | 560 | |
| 262 | fragment | 561 | |
| 264 | fragment | 562 | |
| 282 | fragment | 563 | |
| 299 | fragment | 564 | |
| 362 | fragment | 565 | |
| 405 | fragment | 566 | |
| 405 | fragment | 567 | |
| 406 | fragment | 568 | |
| 545 | fragment | 569 | |
| 685 | fragment | 570 | |
| spy0611 | fragment | 571 | |
| spy0612 | fragment | 572 | |
| spy0613 | fragment | 573 | |
| spy0614 | fragment | 574 | |
| spy0615 | fragment | 575 | |
| spy0616 | fragment | 576 | |
| spy0717 | fragment | 577 | |
| spy0717 | fragment | 578 | |
| spy0792 | fragment | 579 | |
| spy1073 | fragment | 580 | |
| spy1073 | fragment | 581 | |
| NT01SP0908 | fragment | 582 | |
| NT01SP0182 | fragment | 583 | |
| NT04SP1422 | fragment | 584 | |
| spy1111 | fragment | 585 | |
| spy 0216 | fragment | 586 | |
| spy1664 | fragment | 587 | |
| spy0861 | fragment | 588 | |
| 57 Chiron | fragment | 589 | |
| NT01SP0102 | fragment | 590 | |
| 35 | Surface-exposed domain | 591 | |
| 54 | Surface-exposed domain | 592 | |
| 70 | Surface-exposed domain | 593 | |
| 414 | Surface-exposed domain | 594 | |
| 421 | Surface-exposed domain | 595 | |
| 425 | Surface-exposed domain | 596 | |
| 426 | Surface-exposed domain | 597 | |
| 428 | Surface-exposed domain | 598 | |
| 433 | Surface-exposed domain | 599 | |
| 434 | Surface-exposed domain | 600 | |
| 437 | Surface-exposed domain | 601 | |
| 438 | Surface-exposed domain | 602 | |
| 439 | Surface-exposed domain | 603 | |
| 457 | Surface-exposed domain | 604 | |
| 461 | Surface-exposed domain | 605 | |
| 465-1 | Surface-exposed domain | 606 | |
| 465-2 | Surface-exposed domain | 607 | |
| 469 | Surface-exposed domain | 608 | |
| 472 | Surface-exposed domain | 609 | |
| 473 | Surface-exposed domain | 610 | |
| 474 | Surface-exposed domain | 611 | |
| 475 | Surface-exposed domain | 612 | |
| 477 | Surface-exposed domain | 613 | |
| 478 | Surface-exposed domain | 614 | |
| 486 | Surface-exposed domain | 615 | |
| 492 | Surface-exposed domain | 616 | |
| 494 | Surface-exposed domain | 617 | |
| 495 | Surface-exposed domain | 618 | |
| 535 | Surface-exposed domain | 619 | |
| 538 | Surface-exposed domain | 620 | |
| 540 | Surface-exposed domain | 621 | |
| 543 | Surface-exposed domain | 622 | |
| 553 | Surface-exposed domain | 623 | |
| 560 | Surface-exposed domain | 624 | |
| 561 | Surface-exposed domain | 625 | |
| 564 | Surface-exposed domain | 626 | |
| 565 | Surface-exposed domain | 627 | |
| 574 | Surface-exposed domain | 628 | |
| 576 | Surface-exposed domain | 629 | |
| 577-1 | Surface-exposed domain | 630 | |
| 577-2 | Surface-exposed domain | 631 | |
| 579 | Surface-exposed domain | 632 | |
| 586-1 | Surface-exposed domain | 633 | |
| 586-2 | Surface-exposed domain | 634 | |
| 587 | Surface-exposed domain | 635 | |
| 591 | Surface-exposed domain | 636 | |
| 592 | Surface-exposed domain | 637 | |
| 607 | Surface-exposed domain | 638 | |
| 609 | Surface-exposed domain | 639 | |
| 625 | Surface-exposed domain | 640 | |
| 626-1 | Surface-exposed domain | 641 | |
| 626-2 | Surface-exposed domain | 642 | |
| 636 | Surface-exposed domain | 643 | |
| 640 | Surface-exposed domain | 644 | |
| 643 | Surface-exposed domain | 645 | |
| 649 | Surface-exposed domain | 646 | |
| 653 | Surface-exposed domain | 647 | |
| 657 | Surface-exposed domain | 648 | |
| 663 | Surface-exposed domain | 649 | |
| 40N | full-length | 930 | |
| 16p2 | full-length | 971 | 972 |
| 680 | full-length | 973 | 974 |
| M30098 | | 975 | 987 |
| M3_0100 | | 976 | 988 |
| M3_0102 | | 977 | 989 |
| M3_0104 | | 978 | 990 |
| SPs0106 | | 979 | 991 |
| M6_0157 | | 980 | 992 |
| M6_0159 | | 981 | 993 |
| M6_0160 | | 982 | 994 |
| 19224134 | | 983 | 995 |
| 19224135 | | 984 | 996 |
| 19224137 | | 985 | 997 |
| 19224141 | | 986 | 998 |

TABLE 2

GAS antigens present on the surface of multiple M types.

| GAS antigen | M1(5) | M2(1) | M3(3) | M4(2) | M5(1) | M6(3) | M8(1) | M9(1) | M11(1) | M12(1) | M23(1) | ALL(20) |
|---|---|---|---|---|---|---|---|---|---|---|---|---|
| 5 | 5 | 1 | 1 | 1 | 1 | 3 | | 1 | | 1 | | 14 |
| 6 | 1 | 1 | 1 | | | 2 | | | | 1 | 1 | 6 |
| 18 | 5 | | | 1 | 1 | | 1 | | | | | 8 |
| 22 | 4 | 1 | 1 | 1 | 1 | 2 | | | | 1 | | 11 |
| 23 | 2 | | 1 | 2 | 1 | 1 | | | | 1 | | 8 |
| 25 | 3 | | | | 1 | | 1 | | 1 | 1 | | 7 |
| 29 | | | | | | 1 | | | | 1 | 1 | 2 |
| 30 | 1 | | | 1 | | 3 | | | | 1 | | 7 |

TABLE 2-continued

GAS antigens present on the surface of multiple M types.

| GAS antigen | M1(5) | M2(1) | M3(3) | M4(2) | M5(1) | M6(3) | M8(1) | M9(1) | M11(1) | M12(1) | M23(1) | ALL(20) |
|---|---|---|---|---|---|---|---|---|---|---|---|---|
| 36 | 1 | | | | 1 | | | | | 1 | | 3 |
| 49 | 1 | | | | 1 | 2 | | | | | | 4 |
| 56 | 5 | 1 | | 1 | 1 | 1 | 1 | 1 | | | | 11 |
| 60 | 1 | | | | | 1 | | | | | 1 | 2 |
| 62 | 1 | 1 | | | 1 | 2 | | | | 1 | | 6 |
| 63 | | | | | 1 | 3 | | | | | | 4 |
| 65 | | | 1 | | 1 | 3 | | | | | | 5 |
| 67 | 4 | 1 | | | 1 | 1 | 2 | | 1 | | 1 | 10 |
| 68 | 3 | 1 | | | | 1 | 1 | | 1 | 1 | | 8 |
| 69 | 1 | 1 | 1 | 1 | 1 | 2 | | | | 1 | | 8 |
| 74 | | | | | | 1 | | | | | | 1 |
| 75 | 3 | 1 | | 1 | 1 | 3 | | | | | | 9 |
| 76 | 5 | 1 | 1 | | 1 | 2 | | 1 | | 1 | | 12 |
| 77 | 2 | 1 | 1 | 1 | 1 | 3 | 1 | | | 1 | | 11 |
| 78 | | | 1 | | | 2 | | | | | | 3 |
| 81 | 1 | 1 | 1 | | | 1 | 2 | | | | | 6 |
| 82 | | | | | | 2 | | | | | | 2 |
| 85 | | | | | 1 | 3 | | | | | | 4 |
| 86 | | | | | | | | | | 1 | | 1 |
| 89 | 1 | | | | 1 | 1 | | | | 1 | | 4 |
| 91 | | | | | | 1 | | | | 1 | | 2 |
| 92 | | 1 | | | 1 | | | | | 1 | | 3 |
| 93 | 4 | 1 | | | 1 | 2 | | | | 1 | | 9 |
| 94 | 1 | 1 | | 1 | | 1 | 1 | | | 1 | | 6 |
| 96 | 5 | 1 | | 1 | 1 | 3 | | | 1 | 1 | | 13 |
| 97 | 2 | | 1 | 1 | 1 | 2 | | | | | | 7 |
| 98 | 2 | | | | | 1 | | | | 1 | | 4 |
| 99 | 4 | 1 | 1 | 1 | 1 | 3 | 1 | | 1 | 1 | | 14 |
| 100 | 2 | | | | 1 | 1 | | | | | | 4 |
| 101 | 3 | 1 | | | | 2 | | | | | | 6 |
| 103 | 5 | 1 | | 1 | 1 | 2 | 1 | 1 | | 1 | 1 | 13 |
| 104 | 1 | | | | 1 | 2 | | | | | | 4 |
| 105 | 3 | 1 | | | 1 | | 1 | 1 | | | | 7 |
| 108 | 5 | 1 | | | 1 | 2 | 1 | 1 | | 1 | | 12 |
| 123 | 4 | 1 | | 1 | | 1 | | | | 1 | | 8 |
| 131 | 2 | | | | | | | | | 1 | | 3 |
| 142 | 5 | 1 | | 1 | 1 | 2 | | | 1 | 1 | 1 | 12 |
| 143 | 3 | 1 | | 1 | 1 | 2 | | | | | | 8 |
| 158 | 1 | | | | | 2 | | | | | | 3 |
| 165 | | | | | | 1 | | | | 1 | | 2 |
| 166 | 5 | 1 | 2 | 1 | 1 | 2 | 1 | | | 1 | 1 | 14 |
| 175 | 1 | | | 1 | | 1 | | | | | | 3 |
| 178 | 1 | 1 | | | | 1 | | | | | | 3 |
| 179 | | | | 1 | | 2 | | | | 1 | | 4 |
| 187 | 3 | 1 | | | 1 | | 1 | | 1 | | | 7 |
| 188 | 4 | 1 | | 1 | 1 | 3 | 1 | 1 | 1 | | | 13 |
| 190 | 5 | 1 | | 1 | | 2 | | 1 | 1 | 1 | 1 | 12 |
| 195 | 3 | 1 | | | 1 | 1 | | | | 1 | | 7 |
| 205 | | 1 | | | | 2 | | | | 1 | | 4 |
| 206 | 3 | | 1 | 1 | 1 | 1 | | | | 1 | | 8 |
| 207 | 1 | | | | | | | | | | | 1 |
| 218 | | 1 | | | | 1 | | | | 1 | | 3 |
| 219 | | 1 | | | 1 | | | | | | | 2 |
| 242 | 2 | 1 | | | 1 | 2 | | | | 1 | | 7 |
| 249 | 3 | 1 | | 1 | 1 | 1 | | | | 1 | | 8 |
| 271 | | | | | | 1 | | | | | | 1 |
| 291 | 1 | 1 | | | | 1 | | | | 1 | 1 | 4 |
| 327 | | | | | | 1 | | | | 1 | | 2 |
| 380 | 1 | | | | | | | | | | | 1 |
| 685 | n/t | n/t | n/t | n/t | n/t | n/t | n/t | n/t | n/t | n/t | n/t | n/t | n/t = not tested

TABLE 3

In silico-predicted surface-exposed proteins

| GAS | SPY | no. aa | PSORT | TMD | Features | Annotation |
|---|---|---|---|---|---|---|
| 5 | spy0019 | 398 | outside | 0 | | putative secreted protein |
| 6 | spy0031 | 374 | outside | 0 | RGD | putative choline binding protein |
| 18 | spy0130 | 215 | membrane | 2 | LPXTG | hypothetical protein |

TABLE 3-continued

In silico-predicted surface-exposed proteins

| GAS | SPY | no. aa | PSORT | TMD | Features | Annotation |
|---|---|---|---|---|---|---|
| 22 | spy0159 | 292 | outside | 0 | | hypothetical protein |
| 23 | spy0163 | 342 | lipoprotein | 0 | lipoprotein | putative ABC transporter (lipoprotein) |
| 25 | spy0167 | 571 | outside | 0 | | streptolysin O precursor |
| 29 | spy0210 | 410 | lipoprotein | 0 | lipoprotein | hypothetical protein (TGc, Transglutaminase/protease-like GBS682) |
| 30 | spy0212 | 234 | outside | 0 | | exotoxin G precursor |
| 36 | spy0252 | 439 | lipoprotein | 0 | lipoprotein | putative sugar transporter sugar binding lipoprotein |
| 49 | spy0317 | 280 | lipoprotein | 0 | lipoprotein | conserved hypothetical protein |
| 56 | spy0385 | 310 | lipoprotein | 0 | lipoprotein | ferrichrome ABC transporter (ferrichrome-binding protein) |
| 60 | spy0436 | 232 | membrane | 1 | | putative exotoxin (superantigen) |
| 62 | spy0441 | 319 | outside | 0 | RGD | conserved hypothetical protein (Predicted dehydrogenases) |
| 63 | spy0457 | 268 | lipoprotein | 0 | lipoprotein | putative cyclophilin-type protein |
| 65 | spy0711 | 235 | membrane | 1 | | pyrogenic exotoxin C precursor, phage associated |
| 67 | spy0714 | 515 | outside | 0 | | putative adhesion protein |
| 68 | spy0737 | 2045 | membrane | 2 | LPXTG | putative extracellular matrix binding protein |
| 69 | spy0778 | 270 | lipoprotein | 0 | lipoprotein | putative ABC transporter (substrate-binding protein |
| 74 | spy1008 | 236 | outside | 0 | | streptococcal exotoxin H precursor |
| 75 | spy1032 | 805 | outside | 0 | | extracellular hyaluronate lyase |
| 76 | spy1037 | 318 | outside | 0 | | conserved hypothetical protein |
| 77 | spy1054 | 293 | membrane | 1 | LPXTG-RGD | putative collagen-like protein (44%HUM) |
| 78 | spy1094 | 320 | lipoprotein | 0 | lipoprotein | conserved hypothetical protein (S77609 probable adhesion) |
| 81 | spy1228 | 350 | lipoprotein | 0 | lipoprotein | putative lipoprotein |
| 82 | spy1245 | 288 | lipoprotein | 0 | lipoprotein | putative phosphate ABC transporter, periplasmic pho |
| 85 | spy1290 | 206 | lipoprotein | 0 | lipoprotein | hypothetical protein |
| 86 | spy1294 | 415 | lipoprotein | 0 | lipoprotein | putative maltose/maltodextrin-binding protein |
| 87 | spy1302 | 711 | outside | 0 | RGD | putative cyclomaltodextrin glucanotransferase |
| 88 | spy1361 | 792 | lipoprotein | 0 | lipoprotein | putative internalin A precursor |
| 89 | spy1390 | 351 | lipoprotein | 0 | lipoprotein | putative protease maturation protein |
| 91 | spy1491 | 195 | outside | 0 | | conserved hypothetical protein |
| 92 | spy1558 | 207 | lipoprotein | 0 | lipoprotein | hypothetical protein |
| 93 | spy1592 | 380 | lipoprotein | 0 | lipoprotein | conserved hypothetical protein (maltose) |
| 94 | spy1633 | 535 | outside | 0 | | conserved hypothetical protein (hydrolase) |
| 96 | spy1795 | 294 | lipoprotein | 0 | lipoprotein | putative ABC transporter (periplasmic binding protein) |
| 97 | spy1801 | 503 | outside | 0 | | immunogenic secreted protein precursor homolog |
| 98 | spy1882 | 284 | lipoprotein | 0 | lipoprotein | putative acid phosphatase (secreted) |
| 99 | spy1979 | 440 | outside | 0 | | streptokinase A precursor |
| 100 | spy2000 | 542 | lipoprotein | 0 | lipoprotein | surface lipoprotein |
| 101 | spy2007 | 306 | lipoprotein | 0 | lipoprotein | putative laminin adhesion |
| 103 | spy2037 | 309 | lipoprotein | 0 | lipoprotein | conserved hypothetical |
| 104 | spy2039 | 398 | outside | 0 | RGD | pyrogenic exotoxin B (speB) |
| 105 | spy2066 | 498 | outside | 0 | | putative dipeptidase |
| 108 | spy0604 | 128 | lipoprotein | 0 | lipoprotein | hypothetical protein |
| 123 | spy0510 | 308 | membrane | 2 | | putative sugar transferase |
| 131 | spy0601 | 282 | membrane | 1 | | putative endolysin, phage associated |
| 142 | spy0740 | 352 | membrane | 1 | | streptolysin S associated ORF |
| 143 | spy0747 | 910 | membrane | 2 | LPXTG-RGD | conserved hypothetical protein |
| 158 | spy0843 | 1008 | membrane | 1 | LPXTG | hypothetical protein (immunoreactive protein Se110) |
| 165 | spy1326 | 364 | cytoplasm | 0 | RGD | conserved hypothetical protein |
| 166 | spy1357 | 217 | membrane | 1 | LPXTG | protein GRAB (protein G-related alpha 2M-binding pr (delezioni) |
| 171 | spy1494 | 313 | membrane | 1 | LPXTG | hypothetical protein |
| 175 | spy1577 | 357 | membrane | 1 | LPXTG | 3-dehydroquinate synthase |
| 178 | spy1697 | 240 | membrane | 1 | | hypothetical protein (extracellular serine protease) |
| 179 | spy1718 | 328 | outside | 0 | | putative esterase |
| 187 | spy1972 | 1165 | membrane | 2 | LPXTG | putative pullulanase |
| 188 | spy1983 | 348 | membrane | 1 | | collagen-like surface protein (48%HUM) |
| 190 | spy2009 | 379 | membrane | 1 | LPXTG | hypothetical protein |
| 195 | spy2043 | 271 | membrane | 1 | | mitogenic factor |
| 206 | spy0731 | 435 | cytoplasm | 0 | | putative enolase |
| 207 | spy0856 | 199 | outside | 0 | | putative peptidoglycan hycirolase |
| 208 | spy0857 | 235 | outside | 0 | | putative peptidoglycan hydrolase |
| 210 | spy0872 | 670 | membrane | 2 | LPXTG | putative secreted 5'-nucleotidase |
| 218 | spy1006 | 444 | membrane | 1 | | putative lysin-phage associated |
| 219 | spy1007 | 225 | cytoplasm | 0 | | streptococcal exotoxin I |
| 242 | spy1306 | 419 | membrane | 1 | | maltose/maltodextrin-binding protein |
| 249 | spy1497 | 275 | membrane | 1 | | putative hemolysin |
| 271 | spy1850 | 316 | membrane | 1 | | putative esterase |
| 291 | spy1998 | 233 | membrane | 1 | | mitogenic exotoxin Z |
| 327 | spy0513 | 361 | membrane | 1 | | putative XAA-PRO dipeptidase; X-PRO dipeptidase |
| 380 | spy1813 | 995 | outside | 0 | | hypothetical protein (Glycosyl hydrolases family) |
| 205 | spy0453 | 310 | lipoprotein | 0 | lipoprotein | metal binding protein of ABC transporter (lipoprotein) |
| 685 | spy0319 | 281 | lipoprotein | 0 | lipoprotein | conserved hypothetical protein |

LPXTG-RGD (SEQ ID NO: 962)
LPXTG (SEQ ID NO: 931)

TABLE 4A

Strain 2913 (M1)
2913 (M1)

| GAS | preimm | imm | D mean |
|---|---|---|---|
| 190 | 194.42 | 474.68 | 280 |
| 188 | 189.71 | 459.15 | 269 |
| 5 | 191.08 | 437.36 | 246 |
| 18 | 143.38 | 383.45 | 240 |
| gst98 | 206.91 | 437 | 230 |
| gst123 | 164.85 | 366.01 | 201 |
| 76 | 162.58 | 360.52 | 198 |
| 105 | 162.91 | 350.52 | 188 |
| 103 | 137.1 | 311.95 | 175 |
| urea104 | 194.85 | 362.78 | 168 |
| urea131 | 197.29 | 363.6 | 166 |
| 166 | 144.84 | 307.9 | 163 |
| 77 | 210.6 | 370.99 | 160 |
| 49 | 141.14 | 297.46 | 156 |
| 23 | 144.17 | 298.99 | 155 |
| 187 | 204.06 | 356.99 | 153 |
| 100 | 139.63 | 290.75 | 151 |
| 166 | 150.22 | 297.12 | 147 |
| 142 | 143.75 | 289.89 | 146 |
| 96 | 171.49 | 316.8 | 145 |
| 96 | 196.77 | 336 | 139 |
| 108 | 146.23 | 278.17 | 132 |
| 99 | 144.54 | 276.02 | 131 |
| 67 | 152.03 | 279.31 | 127 |
| gst93 | 134.44 | 260.24 | 126 |
| 96 | 139.88 | 265.67 | 126 |
| 99 | 214.7 | 337.29 | 123 |
| 5 | 142.95 | 265.27 | 122 |
| 56 | 147.28 | 268.99 | 122 |
| 22 | 172.13 | 285.71 | 114 |
| 99 | 131.02 | 242.52 | 112 |
| 25 | 258.24 | 367.75 | 110 |
| 5 | 234.57 | 343.37 | 109 |
| gst143 | 210.59 | 318.47 | 108 |
| 117/40 | 173.8 | 270.35 | 97 |
| 195 | 156.71 | 252.98 | 96 |
| 142 | 162.6 | 256.58 | 94 |
| 195 | 144.64 | 235.8 | 91 |
| 40 native | 131.04 | 220.34 | 89 |
| 206 | 208.21 | 295.19 | 87 |
| 158 | 342.78 | 427.07 | 84 |
| 313 | 213.24 | 294.56 | 81 |
| 97 | 237.96 | 318.85 | 81 |
| 30 | 228.04 | 305.4 | 77 |
| 69 | 224.85 | 301.84 | 77 |
| 117/40 | 192.49 | 263.31 | 71 |
| 242 | 132.82 | 202.24 | 69 |
| 91 | 216.61 | 284.68 | 68 |
| 29 | 138.08 | 204.89 | 67 |
| urea210 | 354.84 | 417.89 | 63 |
| 81 | 196.88 | 256.93 | 60 |
| 249 | 137.91 | 197.54 | 60 |
| 75 | 201.32 | 259.63 | 58 |
| 101 | 136.92 | 194.98 | 58 |
| 219 | 202.88 | 260.49 | 58 |
| gst175 | 201.69 | 258.37 | 57 |
| gst68 | 217.7 | 272.94 | 55 |
| 85 | 201.23 | 256.11 | 55 |
| gst6 | 187.31 | 241.82 | 55 |
| 178 | 120.12 | 172.44 | 52 |
| 89 | 220.52 | 271.56 | 51 |
| 82 | 204.97 | 253.43 | 48 |
| 63 | 200.53 | 247.1 | 47 |
| 165 | 304.53 | 346.53 | 42 |
| 36 | 183.7 | 225.55 | 42 |
| 23 | 211.65 | 252.18 | 41 |
| 179 | 132.17 | 171.24 | 39 |
| 86 | 262.12 | 294.72 | 33 |
| gst62 | 205.71 | 237.43 | 32 |
| 291 | 153.15 | 181.2 | 28 |
| 5 | 259.32 | 285.62 | 26 |
| 65 | 182.47 | 208.38 | 26 |
| 327 | 234.5 | 257.44 | 23 |
| 205 | 216.71 | 237.39 | 21 |

TABLE 4A-continued

Strain 2913 (M1)
2913 (M1)

| GAS | preimm | imm | D mean |
|---|---|---|---|
| gst94 | 198.09 | 218.63 | 21 |
| 218 | 145.43 | 165.25 | 20 |
| urea207 | 330 | 348.95 | 19 |
| 88 | 252.44 | 269.1 | 17 |
| gst60 | 187.92 | 197.82 | 10 |
| urea271 | 345.63 | 351.41 | 6 |
| 380 | 152.43 | 158.11 | 6 |
| 92 | 246.3 | 250.22 | 4 |
| gst78 | 190.44 | 179.39 | −11 |
| urea74 | 251.26 | 224.66 | −27 |
| 208 | 315.54 | 107.25 | −208 |

TABLE 4B 3348 (M1)

| GAS | preimm | imm | D mean |
|---|---|---|---|
| 56 | 154.54 | 565.12 | 411 |
| gst98 | 173.97 | 508.69 | 335 |
| 96 | 132.72 | 449.76 | 317 |
| 76 | 151.87 | 426.15 | 274 |
| 190 | 159.41 | 415.54 | 256 |
| 18 | 140.84 | 387.87 | 247 |
| gst123 | 162.67 | 398.89 | 236 |
| 5 | 142.12 | 340.11 | 198 |
| 103 | 156.69 | 343.28 | 187 |
| 188 | 162.2 | 340.96 | 179 |
| urea207 | 222.13 | 373.14 | 151 |
| 101 | 141.15 | 287.3 | 146 |
| 100 | 131.81 | 262.87 | 131 |
| 23 | 148.65 | 270.92 | 122 |
| urea131 | 151.07 | 254.71 | 104 |
| 99 | 202.11 | 305.09 | 103 |
| gst93 | 170.95 | 272.97 | 102 |
| 142 | 150.93 | 252.85 | 102 |
| 99 | 156.22 | 258.05 | 102 |
| 313 | 167.92 | 263.49 | 96 |
| gst143 | 148.32 | 240.51 | 92 |
| 166 | 132.4 | 222.57 | 90 |
| 75 | 162.66 | 252.49 | 90 |
| 108 | 141.38 | 228.92 | 88 |
| 5 | 157.86 | 241.76 | 84 |
| 206 | 167.04 | 248.13 | 81 |
| 77 | 187.09 | 266.41 | 79 |
| 5 | 160.4 | 239.13 | 79 |
| 22 | 157.57 | 233.84 | 76 |
| gst68 | 163.42 | 238.93 | 76 |
| 5 | 231.72 | 306.6 | 75 |
| 49 | 141.86 | 210.64 | 69 |
| urea104 | 158.48 | 226.48 | 68 |
| gst60 | 176.65 | 242.76 | 66 |
| 91 | 163.83 | 229.45 | 66 |
| 142 | 189.99 | 255.48 | 65 |
| urea74 | 228.44 | 292.69 | 64 |
| gst62 | 161.7 | 224.94 | 63 |
| gst78 | 148.6 | 210.04 | 61 |
| 117/40 | 155.18 | 214.79 | 60 |
| 99 | 146.22 | 204.77 | 59 |
| 67 | 162.15 | 218.88 | 57 |
| 166 | 158.91 | 214.36 | 55 |
| gst94 | 153.94 | 209.27 | 55 |
| 96 | 160.91 | 215.65 | 55 |
| gst175 | 176.63 | 229.59 | 53 |
| 81 | 161.63 | 214.56 | 53 |
| 242 | 125.1 | 173.61 | 49 |
| gst6 | 147.33 | 195.11 | 48 |
| 195 | 211.98 | 259.42 | 47 |
| urea210 | 330.82 | 373.55 | 43 |
| 25 | 201.97 | 244.53 | 43 |
| urea271 | 253.08 | 295.28 | 42 |

TABLE 4B-continued 3348 (M1)

| GAS | preimm | imm | D mean |
|---|---|---|---|
| 69 | 151.78 | 193.06 | 41 |
| 89 | 156.08 | 191.86 | 36 |
| 219 | 178.2 | 213.49 | 35 |
| 158 | 215.05 | 249.34 | 34 |
| 96 | 158.73 | 192.02 | 33 |
| 187 | 286.55 | 319.43 | 33 |
| 179 | 155.79 | 186.94 | 31 |
| 291 | 154.52 | 183.63 | 29 |
| 97 | 152.36 | 180.46 | 28 |
| 88 | 171.64 | 198.96 | 27 |
| 65 | 159.69 | 186.94 | 27 |
| 218 | 130.47 | 156.24 | 26 |
| 327 | 156.06 | 178.78 | 23 |
| 195 | 149.34 | 171.32 | 22 |
| 165 | 233.12 | 254.48 | 21 |
| 30 | 153.35 | 173.57 | 20 |
| 63 | 155.73 | 174.4 | 19 |
| 36 | 169.08 | 187.58 | 19 |
| 23 | 152.21 | 170.64 | 18 |
| 205 | 158.05 | 176.23 | 18 |
| 178 | 144.99 | 163.17 | 18 |
| 82 | 154.34 | 171.49 | 17 |
| 85 | 158.6 | 174.66 | 16 |
| 92 | 155.68 | 167.71 | 12 |
| 40 native | 179.42 | 180.18 | 1 |
| 86 | 188.83 | 186.3 | −3 |
| 29 | 185.03 | 178.03 | −7 |
| 249 | 195.31 | 187.28 | −8 |
| 117/40 | 189.5 | 181.12 | −8 |
| 380 | 245.4 | 232.35 | −13 |
| 105 | 266.98 | 225.36 | −42 |
| 208 | 228.37 | 99.93 | −128 |

TABLE 4C 2726 (M2)

| GAS | preimm | imm | D mean |
|---|---|---|---|
| 117/40 | 169.41 | 635.25 | 466 |
| 117/40 | 143.81 | 605.99 | 462 |
| 40/117 | 158.74 | 552.21 | 393 |
| 40 native | 139.5 | 380.45 | 241 |
| 76 | 218.18 | 448.62 | 230 |
| 103 | 262.45 | 487.61 | 225 |
| 166 | 258.79 | 466.42 | 208 |
| 142 | 234.83 | 427.39 | 193 |
| 67 | 265.37 | 452.94 | 188 |
| 249 | 164.53 | 348.69 | 184 |
| 96 | 243.06 | 416.55 | 173 |
| 108 | 281.02 | 445.13 | 164 |
| 99 | 246.77 | 409.67 | 163 |
| 5 | 182.49 | 342.3 | 160 |
| 242 | 257.92 | 411.8 | 154 |
| 56 | 301.63 | 452.16 | 151 |
| gst62 | 214.58 | 364.68 | 150 |
| 96 | 162.15 | 311.47 | 149 |
| 142 | 250.32 | 388.62 | 138 |
| 218 | 173.66 | 309.95 | 136 |
| 291 | 180 | 315.83 | 136 |
| 5 | 274.6 | 409.78 | 135 |
| 178 | 177.67 | 303.8 | 126 |
| 195 | 304.08 | 429.06 | 125 |
| 75 | 241.94 | 366.38 | 124 |
| 81 | 218.18 | 333.76 | 116 |
| 205 | 220.27 | 333.86 | 114 |
| 190 | 231.56 | 344.2 | 113 |
| 69 | 253.55 | 364.87 | 111 |
| gst143 | 257.27 | 367.77 | 111 |
| 105 | 355.04 | 464 | 109 |
| 22 | 245.28 | 353.51 | 108 |
| 5 | 201.38 | 306.56 | 105 |

TABLE 4C-continued 2726 (M2)

| GAS | preimm | imm | D mean |
|---|---|---|---|
| 219 | 236.94 | 341.08 | 104 |
| 99 | 168.81 | 266.95 | 98 |
| gst123 | 258.21 | 354.86 | 97 |
| 313 | 277.05 | 371.2 | 94 |
| 101 | 279.03 | 372.94 | 94 |
| gst6 | 254.54 | 348.01 | 93 |
| 77 | 165.4 | 258.53 | 93 |
| 92 | 262.48 | 355.06 | 93 |
| gst68 | 277.82 | 368.27 | 90 |
| 187 | 422.69 | 509.5 | 87 |
| gst93 | 256.06 | 339.72 | 84 |
| gst94 | 238.26 | 321.47 | 83 |
| 188 | 157.15 | 237.48 | 80 |
| 29 | 236.32 | 315.54 | 79 |
| gst78 | 251.67 | 329.48 | 78 |
| 36 | 236.52 | 313.69 | 77 |
| gst60 | 246.97 | 323.18 | 76 |
| 327 | 253.71 | 327.93 | 74 |
| 85 | 162.02 | 234.58 | 73 |
| 166 | 325.96 | 392.88 | 67 |
| 91 | 321 | 387.03 | 66 |
| 65 | 176.06 | 241.8 | 66 |
| 23 | 181.48 | 246.57 | 65 |
| 158 | 287.96 | 350.68 | 63 |
| 97 | 181.05 | 242.52 | 61 |
| gst98 | 280.75 | 339.55 | 59 |
| 195 | 286.74 | 344.69 | 58 |
| 5 | 235.88 | 292.3 | 56 |
| 206 | 181.9 | 234.11 | 52 |
| 30 | 200.18 | 250.63 | 50 |
| 88 | 294.93 | 342.22 | 47 |
| 179 | 191.53 | 235.8 | 44 |
| 380 | 312.64 | 347.72 | 35 |
| 63 | 160.74 | 193.38 | 33 |
| 25 | 467.96 | 499.72 | 32 |
| 23 | 196.86 | 225.27 | 28 |
| 86 | 324.63 | 350.05 | 25 |
| 82 | 253.46 | 276.32 | 23 |
| 89 | 194.88 | 217.01 | 22 |
| urea210 | 347.49 | 359.69 | 12 |
| 18 | 193 | 202.94 | 10 |
| 96 | 231.62 | 218.69 | −13 |
| 99 | 188.69 | 174.54 | −14 |
| urea104 | 283.67 | 256.24 | −27 |
| urea271 | 339.03 | 309.14 | −30 |
| 49 | 238.07 | 198.74 | −39 |
| urea74 | 295.64 | 239.71 | −56 |
| 100 | 233.87 | 174.3 | −60 |
| urea207 | 349.08 | 286.99 | −62 |
| 208 | 270.34 | 194.92 | −75 |
| 165 | 284.04 | 189.33 | −95 |
| urea131 | 283.02 | 172.91 | −110 |
| gst175 | 358.69 | 140.1 | −219 |

TABLE 4D 3040 (M3)

| GAS | preimm | imm | D mean |
|---|---|---|---|
| gst78 | 165.03 | 282.6 | 118 |
| 206 | 194.34 | 305.19 | 111 |
| 5 | 194.31 | 300.67 | 106 |
| 99 | 202.73 | 307.71 | 105 |
| 77 | 184.54 | 288.6 | 104 |
| 81 | 167.66 | 264.24 | 97 |
| 97 | 186.2 | 281.97 | 96 |
| gst6 | 170.39 | 261.83 | 91 |
| 65 | 181.08 | 269.99 | 89 |
| 5 | 185.58 | 272.75 | 87 |
| 69 | 175.92 | 261.83 | 86 |
| 22 | 178.99 | 261.25 | 82 |

TABLE 4D-continued

3040 (M3)

| GAS | preimm | imm | D mean |
|---|---|---|---|
| 23 | 184.44 | 266.54 | 82 |
| 76 | 177.15 | 257.16 | 80 |
| 188 | 190.11 | 267.91 | 78 |
| gst62 | 170.45 | 244.75 | 74 |
| 5 | 210.52 | 279.67 | 69 |
| 190 | 173.27 | 242.19 | 69 |
| 86 | 198.28 | 263.6 | 65 |
| 313 | 185.15 | 250.41 | 65 |
| 96 | 176.77 | 236.77 | 60 |
| 219 | 196.43 | 254.4 | 58 |
| 327 | 188.42 | 241.55 | 53 |
| gst68 | 190.6 | 242.94 | 52 |
| gst93 | 183.17 | 232.96 | 50 |
| 85 | 167.91 | 217.39 | 49 |
| 89 | 186.18 | 234.75 | 49 |
| gst175 | 194.08 | 241.57 | 47 |
| 30 | 192.04 | 239 | 47 |
| 88 | 196.06 | 240.78 | 45 |
| gst60 | 180.47 | 222.06 | 42 |
| 75 | 167.31 | 204.26 | 37 |
| 91 | 203.53 | 237.3 | 34 |
| 82 | 189.88 | 222.78 | 33 |
| gst94 | 191.97 | 221.13 | 29 |
| 205 | 202.78 | 229.36 | 27 |
| 36 | 168.15 | 194.4 | 26 |
| 63 | 245.76 | 269.86 | 24 |
| 92 | 184.31 | 189.26 | 5 |
| gst143 | 187.36 | 158.17 | −29 |

TABLE 4E

3135 (M3)

| GAS | preimm | imm | D mean |
|---|---|---|---|
| 166 | 110.13 | 394.61 | 284 |
| 166 | 107.56 | 382.36 | 275 |
| urea131 | 114.39 | 174.55 | 60 |
| 103 | 106.67 | 166.24 | 60 |
| 158 | 122.44 | 175.29 | 53 |
| 5 | 122.45 | 163.77 | 41 |
| 23 | 121.36 | 161.69 | 40 |
| 195 | 107.19 | 147.11 | 40 |
| urea104 | 111.36 | 147.25 | 36 |
| 97 | 122.67 | 156.78 | 34 |
| 25 | 137.45 | 171.09 | 34 |
| 77 | 124.69 | 155.7 | 31 |
| 99 | 130.22 | 159.98 | 30 |
| 56 | 106.91 | 132.45 | 26 |
| 108 | 106.5 | 131.78 | 25 |
| 206 | 124.87 | 147.61 | 23 |
| 188 | 123.84 | 145.6 | 22 |
| gst78 | 119.2 | 140.45 | 21 |
| 29 | 108.28 | 128.56 | 20 |
| 63 | 126.8 | 147.01 | 20 |
| gst98 | 110.66 | 129.86 | 19 |
| 313 | 126.91 | 145.44 | 19 |
| 96 | 111.43 | 129.23 | 18 |
| 5 | 128.79 | 145.75 | 17 |
| 49 | 108.24 | 124.96 | 17 |
| 99 | 105.45 | 122.12 | 17 |
| 65 | 124.99 | 141.46 | 16 |
| 22 | 123.41 | 139.65 | 16 |
| gst62 | 123.52 | 139.61 | 16 |
| 67 | 105.52 | 121.18 | 16 |
| 249 | 106.75 | 122.12 | 15 |
| 291 | 110.37 | 125.59 | 15 |
| 142 | 108.05 | 123.01 | 15 |
| 5 | 111.21 | 125.9 | 15 |
| 219 | 120.29 | 134.55 | 14 |
| urea210 | 133.06 | 146.91 | 14 |
| 96 | 120.11 | 133.93 | 14 |

TABLE 4E-continued

3135 (M3)

| GAS | preimm | imm | D mean |
|---|---|---|---|
| 81 | 119.08 | 132.81 | 14 |
| 99 | 106.41 | 120.04 | 14 |
| urea271 | 121.47 | 134.91 | 13 |
| 5 | 126.45 | 139.79 | 13 |
| gst143 | 124.56 | 137.5 | 13 |
| gst93 | 120.4 | 132.87 | 12 |
| 76 | 122.05 | 134.36 | 12 |
| 86 | 127.78 | 140.06 | 12 |
| 195 | 111.37 | 122.97 | 12 |
| 218 | 109.75 | 121.32 | 12 |
| gst6 | 121.82 | 133.37 | 12 |
| 117/40 | 107.5 | 118.49 | 11 |
| 23 | 106.15 | 116.48 | 10 |
| 30 | 125.53 | 135.78 | 10 |
| urea74 | 114.41 | 124.63 | 10 |
| gst123 | 110.37 | 120.25 | 10 |
| 18 | 107.52 | 117.28 | 10 |
| 85 | 121.62 | 131.21 | 10 |
| 100 | 107.13 | 116.71 | 10 |
| 89 | 123.02 | 132.21 | 9 |
| 117/40 | 109.32 | 118.42 | 9 |
| 69 | 122 | 130.75 | 9 |
| 142 | 107.56 | 116.23 | 9 |
| 179 | 108.33 | 116.82 | 8 |
| 75 | 120.38 | 128.56 | 8 |
| 327 | 123.25 | 130.86 | 8 |
| 40 native | 107.54 | 114.46 | 7 |
| 101 | 109.87 | 116.68 | 7 |
| 190 | 122.5 | 129.25 | 7 |
| 178 | 106.51 | 112.97 | 6 |
| urea207 | 115.66 | 122.06 | 6 |
| 380 | 107.39 | 112.46 | 5 |
| 88 | 128.77 | 133.4 | 5 |
| 165 | 118.63 | 122.64 | 4 |
| gst94 | 122.63 | 126.36 | 4 |
| 91 | 127.34 | 130.97 | 4 |
| gst60 | 122.62 | 125.76 | 3 |
| 205 | 124.21 | 127.27 | 3 |
| 92 | 122.58 | 125.45 | 3 |
| 82 | 126.38 | 128.68 | 2 |
| 36 | 119.01 | 119.08 | 0 |
| gst68 | 126.75 | 124.32 | −2 |
| gst175 | 127.17 | 124.35 | −3 |
| 242 | 107.62 | 103.99 | −4 |
| 187 | 137.54 | 133.22 | −4 |
| 105 | 129.67 | 120.74 | −9 |
| 208 | 123.3 | 102.4 | −21 |
| 96 | 200.67 | 137.45 | −63 |

TABLE 4F

2721 (M3)

| GAS | preimm | imm | D mean |
|---|---|---|---|
| 166 | 99.66 | 226.57 | 127 |
| 166 | 97.13 | 198.93 | 102 |
| 103 | 98.07 | 140.45 | 42 |
| 23 | 125.99 | 159.23 | 33 |
| 25 | 103.57 | 129.87 | 26 |
| 195 | 98.17 | 124.06 | 26 |
| gst62 | 112.5 | 138.24 | 26 |
| 206 | 117.76 | 134.66 | 17 |
| urea74 | 119.74 | 136.43 | 17 |
| 100 | 99.01 | 114.15 | 15 |
| urea104 | 98.42 | 112.99 | 15 |
| 22 | 121.44 | 135.44 | 14 |
| urea131 | 100.88 | 114.48 | 14 |
| 5 | 114.52 | 127.44 | 13 |
| 108 | 98.18 | 109.68 | 12 |
| gst6 | 111.2 | 122.5 | 11 |
| 86 | 115.72 | 125.96 | 10 |

TABLE 4F-continued

2721 (M3)

| GAS | preimm | imm | D mean |
|---|---|---|---|
| 85 | 116.36 | 126.5 | 10 |
| 76 | 113.43 | 123.38 | 10 |
| 82 | 113.19 | 122.65 | 9 |
| 77 | 111.92 | 121.12 | 9 |
| 81 | 112.89 | 121.83 | 9 |
| 99 | 116.07 | 124.65 | 9 |
| 5 | 117.05 | 125.62 | 9 |
| 40 native | 98.41 | 106.2 | 8 |
| 29 | 95.88 | 102.59 | 7 |
| 89 | 119.9 | 126.61 | 7 |
| 97 | 117.88 | 124 | 6 |
| 158 | 101.16 | 107.22 | 6 |
| 75 | 114.86 | 120.8 | 6 |
| 142 | 96.49 | 102.22 | 6 |
| 219 | 114.33 | 120 | 6 |
| 36 | 112.86 | 118.36 | 6 |
| 195 | 96.7 | 102.04 | 5 |
| 99 | 100.79 | 106 | 5 |
| 380 | 96.79 | 101.99 | 5 |
| 5 | 97.09 | 102.14 | 5 |
| gst78 | 113.72 | 118.69 | 5 |
| 63 | 114.63 | 119.19 | 5 |
| gst94 | 115.6 | 120.06 | 4 |
| 96 | 100.89 | 105.27 | 4 |
| 142 | 97.66 | 101.88 | 4 |
| 40/117 | 100.57 | 104.78 | 4 |
| 30 | 116.53 | 120.66 | 4 |
| 291 | 96.92 | 100.84 | 4 |
| 96 | 120.86 | 124.77 | 4 |
| 99 | 97.66 | 101.3 | 4 |
| 67 | 97.27 | 100.85 | 4 |
| 242 | 98.01 | 101.18 | 3 |
| 205 | 115.96 | 119.07 | 3 |
| 165 | 103.2 | 106.27 | 3 |
| 49 | 99.45 | 102.5 | 3 |
| 18 | 99.52 | 102.47 | 3 |
| 190 | 95.57 | 98.34 | 3 |
| 179 | 98 | 100.56 | 3 |
| 101 | 101.58 | 104.06 | 2 |
| 327 | 113.06 | 115.17 | 2 |
| 117/40 | 99.08 | 101.18 | 2 |
| 69 | 118.09 | 120.08 | 2 |
| 249 | 99.02 | 100.83 | 2 |
| 96 | 108.49 | 110.08 | 2 |
| 218 | 97.68 | 99.27 | 2 |
| 178 | 96 | 97.27 | 1 |
| gst123 | 116.42 | 117.54 | 1 |
| 5 | 118.39 | 119.44 | 1 |
| gst93 | 116.77 | 117.66 | 1 |
| 56 | 106.85 | 107.74 | 1 |
| 187 | 106.45 | 107.29 | 1 |
| 92 | 120.72 | 120.96 | 0 |
| 23 | 105.99 | 105.83 | −0 |
| 65 | 119.21 | 118.99 | −0 |
| urea271 | 117.8 | 117.44 | −0 |
| 91 | 128.08 | 126.95 | −1 |
| urea210 | 117.69 | 115.93 | −2 |
| 313 | 118.61 | 116.49 | −2 |
| gst175 | 116.58 | 114.1 | −2 |
| 105 | 106.21 | 102.57 | −4 |
| urea207 | 120.6 | 116.8 | −4 |
| gst68 | 123.6 | 115.02 | −9 |
| 88 | 128.51 | 117.28 | −11 |
| 188 | 136.12 | 124.71 | −11 |
| gst98 | 124.32 | 112.82 | −12 |
| gst143 | 134.75 | 121.5 | −13 |
| gst60 | 135.21 | 119.59 | −16 |

TABLE 4G

2634 (M4)

| GAS | preimm | imm | D mean |
|---|---|---|---|
| 5 | 152.3 | 397.43 | 245 |
| 142 | 200.73 | 391.1 | 190 |
| 77 | 172.99 | 361.68 | 189 |
| 97 | 145.78 | 326.33 | 181 |
| 179 | 138.12 | 312.92 | 175 |
| 40 native | 206.13 | 375.63 | 170 |
| 67 | 189.05 | 357.68 | 169 |
| 96 | 208.98 | 376.29 | 167 |
| 103 | 193.23 | 359.56 | 166 |
| 99 | 152.4 | 312.85 | 160 |
| 65 | 149.8 | 309.86 | 160 |
| 30 | 214.78 | 369.95 | 155 |
| 5 | 149.11 | 304.03 | 155 |
| 23 | 182.23 | 331.41 | 149 |
| gst94 | 206.2 | 342.91 | 137 |
| 22 | 197.28 | 330.34 | 133 |
| gst175 | 209.41 | 335.86 | 126 |
| 75 | 195.62 | 315.74 | 120 |
| 5 | 139.66 | 254.37 | 115 |
| 99 | 179.89 | 294.17 | 114 |
| 188 | 200.24 | 313.88 | 114 |
| 166 | 172.06 | 285.61 | 114 |
| 63 | 270.77 | 381.55 | 111 |
| gst62 | 207.91 | 318.39 | 110 |
| 56 | 193.55 | 303.44 | 110 |
| 166 | 184.73 | 289 | 104 |
| 18 | 206.67 | 306.03 | 99 |
| 117-40 | 210.77 | 306.45 | 96 |
| 249 | 120.31 | 215.54 | 95 |
| gst123 | 244.06 | 334.45 | 90 |
| gst143 | 187.74 | 277.76 | 90 |
| 99 | 200.38 | 289.4 | 89 |
| 190 | 206.02 | 292.65 | 87 |
| 206 | 354.53 | 440.07 | 86 |
| 101 | 189.01 | 266.42 | 77 |
| gst6 | 222.38 | 299.01 | 77 |
| gst60 | 232.53 | 309.02 | 76 |
| 195 | 187.95 | 263.95 | 76 |
| 76 | 201.83 | 277.53 | 76 |
| 81 | 171.97 | 245.71 | 74 |
| 96 | 192.32 | 262.29 | 70 |
| gst93 | 227.24 | 295.46 | 68 |
| gst68 | 225.46 | 292.55 | 67 |
| 49 | 256.66 | 323.34 | 67 |
| gst78 | 198.87 | 264.72 | 66 |
| 69 | 195.79 | 260.58 | 65 |
| 108 | 233.34 | 298.06 | 65 |
| 195 | 180.52 | 241.19 | 61 |
| 219 | 167.02 | 226 | 59 |
| 105 | 308.53 | 365.92 | 57 |
| 291 | 117.07 | 172.87 | 56 |
| 142 | 186.09 | 239.15 | 53 |
| 5 | 170.81 | 223.48 | 53 |
| 25 | 346.28 | 397.53 | 51 |
| 23 | 195.69 | 245.88 | 50 |
| 85 | 316.65 | 359.95 | 43 |
| 91 | 249.58 | 292.39 | 43 |
| 165 | 268.89 | 309.85 | 41 |
| 29 | 129.86 | 168.67 | 39 |
| gst98 | 230.53 | 269.14 | 39 |
| 380 | 220.91 | 257.34 | 36 |
| 187 | 344.99 | 378.74 | 34 |
| 158 | 382.35 | 415.03 | 33 |
| 218 | 123.8 | 154.83 | 31 |
| urea104 | 255.47 | 281.99 | 27 |
| 36 | 207.01 | 233.44 | 26 |
| 242 | 258.94 | 284.93 | 26 |
| 92 | 284.03 | 309.39 | 25 |
| 205 | 250.69 | 275.3 | 25 |
| 96 | 243.12 | 265.11 | 22 |
| 327 | 184.43 | 205.62 | 21 |
| 88 | 257.24 | 277.7 | 20 |
| 100 | 245.7 | 263.38 | 18 |
| 313 | 248.95 | 264.11 | 15 |
| urea210 | 541.55 | 550.33 | 9 |

TABLE 4G-continued 2634 (M4)

| GAS | preimm | imm | D mean |
|---|---|---|---|
| 82 | 232.34 | 233.15 | 1 |
| 86 | 275.19 | 260.17 | −15 |
| urea207 | 385.62 | 341.2 | −44 |
| urea74 | 298.46 | 248.91 | −50 |
| urea131 | 350.76 | 300.23 | −51 |
| 208 | 385.47 | 324.29 | −61 |
| urea271 | 373.94 | 312.57 | −61 |
| 89 | 327.1 | 115.03 | −212 |

TABLE 4H 2722 (M4)

| GAS | preimm | imm | D mean |
|---|---|---|---|
| 23 | 97.88 | 248.22 | 150 |
| 23 | 137.39 | 278.58 | 141 |
| 69 | 140.97 | 221.83 | 81 |
| 188 | 141.87 | 216.09 | 74 |
| 97 | 155.1 | 226.67 | 72 |
| 77 | 144.43 | 196.68 | 52 |
| 108 | 107.91 | 159.37 | 51 |
| 96 | 98.02 | 145.04 | 47 |
| 117/40 | 109.57 | 153.16 | 44 |
| 101 | 111.9 | 155.44 | 44 |
| 96 | 129.15 | 170.61 | 41 |
| 99 | 97.92 | 138.62 | 41 |
| 96 | 100.25 | 134.01 | 34 |
| 5 | 143.26 | 176.88 | 34 |
| 65 | 147.92 | 180.96 | 33 |
| 142 | 108.6 | 140.41 | 32 |
| 242 | 105.99 | 136.91 | 31 |
| 99 | 136.6 | 166.22 | 30 |
| 166 | 109.37 | 138.29 | 29 |
| 40 native | 103.23 | 130.36 | 27 |
| 25 | 125.33 | 151.38 | 26 |
| 18 | 107.22 | 131.87 | 25 |
| 5 | 108.33 | 131.9 | 24 |
| 56 | 112.92 | 135.88 | 23 |
| 30 | 146.84 | 169.5 | 23 |
| 85 | 142.96 | 165.36 | 22 |
| 291 | 119.24 | 141.22 | 22 |
| 166 | 107.78 | 129.32 | 22 |
| gst175 | 130.2 | 150.6 | 20 |
| 75 | 135.54 | 155.88 | 20 |
| 195 | 108.7 | 128.47 | 20 |
| 5 | 136.9 | 156.55 | 20 |
| 218 | 111.31 | 130.3 | 19 |
| 380 | 115.11 | 133.89 | 19 |
| 100 | 110.41 | 128.88 | 18 |
| 76 | 132.33 | 150.76 | 18 |
| 89 | 155.47 | 171.89 | 16 |
| 249 | 119.23 | 134.44 | 15 |
| 142 | 105.42 | 120.62 | 15 |
| urea104 | 126.08 | 140.6 | 15 |
| 92 | 150.99 | 164.91 | 14 |
| 206 | 129.28 | 142.78 | 14 |
| 103 | 111.19 | 124.28 | 13 |
| 219 | 141.75 | 154.3 | 13 |
| urea74 | 141.75 | 154.3 | 13 |
| 195 | 112.18 | 123.63 | 11 |
| 49 | 124.86 | 134.86 | 10 |
| 29 | 114.18 | 122.71 | 9 |
| 178 | 107.62 | 115.69 | 8 |
| 67 | 116.67 | 124.72 | 8 |
| 190 | 110.36 | 117.59 | 7 |
| 22 | 137.2 | 144.24 | 7 |
| 187 | 129.17 | 135.91 | 7 |
| 36 | 136.41 | 141.8 | 5 |
| gst143 | 158.83 | 161.79 | 3 |
| urea131 | 137.35 | 140.19 | 3 |
| 63 | 154.01 | 156.15 | 2 |

TABLE 4H-continued 2722 (M4)

| GAS | preimm | imm | D mean |
|---|---|---|---|
| gst123 | 154.11 | 154.7 | 1 |
| gst68 | 128.03 | 127.53 | −1 |
| 5 | 149.42 | 148.74 | −1 |
| 81 | 155.94 | 153.99 | −2 |
| 165 | 132.37 | 129.72 | −3 |
| gst94 | 161.13 | 157.93 | −3 |
| 105 | 153.39 | 149.82 | −4 |
| gst78 | 153.06 | 148.37 | −5 |
| gst93 | 153.06 | 148.37 | −5 |
| 40/117 | 113.26 | 108.52 | −5 |
| 179 | 116.34 | 109.89 | −6 |
| 205 | 149.42 | 141.91 | −8 |
| 99 | 114.82 | 106.42 | −8 |
| gst98 | 128.83 | 120.31 | −9 |
| gst62 | 137.47 | 127.62 | −10 |
| 158 | 147.38 | 137.25 | −10 |
| urea207 | 148.83 | 136.7 | −12 |
| gst60 | 155.88 | 143.3 | −13 |
| urea210 | 138.97 | 124.07 | −15 |
| 82 | 189.74 | 173.22 | −17 |
| 86 | 189.74 | 173.22 | −17 |
| 327 | 150.01 | 132.88 | −17 |
| urea271 | 150.21 | 128.89 | −21 |
| 313 | 155.89 | 122.48 | −33 |
| gst6 | 167.46 | 130.87 | −37 |
| 88 | 219.73 | 153.36 | −66 |
| 91 | 208.02 | 138.55 | −69 |

TABLE 4I 4883 (M5)

| GAS | preimm | imm | D mean |
|---|---|---|---|
| 166 | 168.08 | 658.05 | 490 |
| 166 | 165.97 | 561.89 | 396 |
| 188 | 158.41 | 470.79 | 312 |
| 105 | 165.89 | 386.89 | 221 |
| 5 | 172.8 | 385.83 | 213 |
| 103 | 171.03 | 374.92 | 204 |
| 96 | 126.2 | 307.83 | 182 |
| 76 | 148.37 | 322.02 | 174 |
| 99 | 132.8 | 306.27 | 173 |
| 18 | 152.55 | 324.52 | 172 |
| 23 | 178.37 | 345.95 | 168 |
| 108 | 170.05 | 337.28 | 167 |
| 5 | 164.47 | 331.69 | 167 |
| 96 | 173.69 | 332.21 | 159 |
| 219 | 158.54 | 316.44 | 158 |
| 56 | 170.51 | 326.88 | 156 |
| 49 | 200.4 | 351.73 | 151 |
| 249 | 197.84 | 347.45 | 150 |
| 91 | 151.74 | 297.29 | 146 |
| 142 | 165.79 | 308.31 | 143 |
| gst143 | 135.52 | 276.76 | 141 |
| 89 | 187.95 | 326.22 | 138 |
| 75 | 152.83 | 287.85 | 135 |
| 5 | 203.45 | 338.02 | 135 |
| 206 | 183.94 | 316.72 | 133 |
| 25 | 341.2 | 469.66 | 128 |
| 96 | 177.21 | 298.03 | 121 |
| urea104 | 245.89 | 366.21 | 120 |
| 100 | 168.38 | 285.21 | 117 |
| 77 | 164 | 279.52 | 116 |
| 22 | 164.9 | 280.12 | 115 |
| 242 | 131.42 | 243.7 | 112 |
| 97 | 200.15 | 312.03 | 112 |
| 99 | 183.36 | 292.17 | 109 |
| 67 | 199.44 | 306.77 | 107 |
| 117/40 | 180.44 | 284.98 | 105 |
| 187 | 282.97 | 385.77 | 103 |
| 69 | 183.69 | 286.03 | 102 |

TABLE 4I-continued

4883 (M5)

| GAS | preimm | imm | D mean |
|---|---|---|---|
| 313 | 181.71 | 282.71 | 101 |
| 30 | 210.71 | 309.77 | 99 |
| 5 | 191.86 | 283.4 | 92 |
| 92 | 191.56 | 280.21 | 89 |
| 81 | 150.24 | 237.13 | 87 |
| 85 | 177.92 | 261.37 | 83 |
| 40 native | 156.37 | 239.74 | 83 |
| 142 | 188.04 | 270.25 | 82 |
| gst93 | 186.95 | 268.54 | 82 |
| 36 | 168.8 | 248.91 | 80 |
| 195 | 206.43 | 286.27 | 80 |
| gst60 | 177.95 | 254.54 | 77 |
| 158 | 349.52 | 421.71 | 72 |
| 88 | 200.83 | 271.87 | 71 |
| 99 | 197.02 | 267.2 | 70 |
| gst175 | 167.52 | 232.11 | 65 |
| gst123 | 174.58 | 237.59 | 63 |
| 63 | 194.37 | 256.6 | 62 |
| 195 | 196.35 | 256.42 | 60 |
| gst94 | 146.23 | 205.9 | 60 |
| gst68 | 170.9 | 228.28 | 57 |
| 101 | 178.22 | 234.99 | 57 |
| gst6 | 160.59 | 214.73 | 54 |
| gst62 | 169.3 | 222.78 | 53 |
| 82 | 179.13 | 230.78 | 52 |
| 190 | 150.06 | 199.69 | 50 |
| 86 | 187.38 | 234.82 | 47 |
| 165 | 311.26 | 353.96 | 43 |
| 327 | 209.87 | 252.47 | 43 |
| gst98 | 183.87 | 226.28 | 42 |
| 205 | 197.32 | 235.07 | 38 |
| 23 | 201.14 | 237.49 | 36 |
| urea131 | 248.92 | 280.6 | 32 |
| 29 | 180.49 | 211.61 | 31 |
| 291 | 191.64 | 221.8 | 30 |
| 380 | 202.47 | 232.62 | 30 |
| 178 | 163.68 | 186.63 | 23 |
| 218 | 180.28 | 202.04 | 22 |
| 179 | 169.68 | 177.87 | 8 |
| 65 | 200.91 | 207.62 | 7 |
| gst78 | 170.15 | 172.79 | 3 |
| urea210 | 200.16 | 181.32 | 9 |
| 40/117 | 220.63 | 200.3 | −20 |
| urea271 | 261.57 | 236.15 | −25 |
| urea207 | 267.75 | 231.12 | −37 |
| urea74 | 267.05 | 190.64 | −76 |

TABLE 4J

5529 (M6)

| GAS | preimm | imm | D mean |
|---|---|---|---|
| gst143 | 216.28 | 565.3 | 349 |
| 5 | 222.8 | 565.32 | 343 |
| gst93 | 218.01 | 491.78 | 274 |
| 96 | 209.54 | 474.43 | 265 |
| 190 | 209.35 | 441.87 | 233 |
| gst78 | 194.51 | 426.44 | 232 |
| 81 | 188.65 | 386.95 | 198 |
| 5 | 207.04 | 402.67 | 196 |
| gst6 | 208.73 | 401.26 | 193 |
| 77 | 250.02 | 438.29 | 188 |
| 99 | 201.93 | 389.12 | 187 |
| gst175 | 243.91 | 429.67 | 186 |
| 205 | 203.33 | 387.87 | 185 |
| 5 | 213.11 | 395.56 | 182 |
| 313 | 240.06 | 420.21 | 180 |
| 65 | 227.98 | 398.01 | 170 |
| 75 | 242.58 | 408.08 | 166 |
| gst62 | 268.21 | 433.22 | 165 |
| 97 | 218.49 | 383.14 | 165 |

TABLE 4J-continued

5529 (M6)

| GAS | preimm | imm | D mean |
|---|---|---|---|
| 85 | 203.95 | 363.71 | 160 |
| 30 | 224.9 | 383.85 | 159 |
| gst60 | 250.6 | 407.31 | 157 |
| 188 | 231.95 | 380.57 | 149 |
| 76 | 252.76 | 400.5 | 148 |
| 63 | 273.29 | 410.45 | 137 |
| gst94 | 335.69 | 464.28 | 129 |
| 22 | 239.55 | 365.06 | 126 |
| 327 | 221.26 | 344.22 | 123 |
| 69 | 239.73 | 361.33 | 122 |
| gst68 | 240.06 | 359.89 | 120 |
| 89 | 258.01 | 371.03 | 113 |
| 82 | 221.43 | 328.02 | 107 |
| 23 | 267.29 | 356.28 | 89 |
| 206 | 269.61 | 355.03 | 85 |
| 92 | 261.57 | 311.12 | 50 |
| 36 | 238.33 | 281.48 | 43 |
| 219 | 313.65 | 329.71 | 16 |
| 88 | 301.67 | 297.26 | −4 |
| 86 | 326.51 | 315.05 | 1 |
| 91 | 376.73 | 362.68 | 4 |

TABLE 4K

2894 (M6)

| GAS | preimm | imm | D mean |
|---|---|---|---|
| 96 | 142.82 | 468.85 | 326 |
| 166 | 197.13 | 497.83 | 301 |
| 5 | 161.1 | 442.77 | 282 |
| 5 | 182.49 | 421.83 | 239 |
| 178 | 133.19 | 366.71 | 234 |
| 142 | 166.61 | 397.1 | 230 |
| gst143 | 175.94 | 401.93 | 226 |
| 99 | 205.67 | 425.2 | 220 |
| gst98 | 175.67 | 394.34 | 219 |
| 190 | 140.21 | 350.66 | 210 |
| urea271 | 288.29 | 498.29 | 210 |
| 76 | 150.29 | 353.93 | 204 |
| 96 | 136.19 | 336.53 | 200 |
| 85 | 142.74 | 339.31 | 197 |
| 166 | 162.51 | 358.59 | 196 |
| gst6 | 156.35 | 351.42 | 195 |
| 195 | 134.89 | 328.14 | 193 |
| gst123 | 194.87 | 383.44 | 189 |
| 142 | 200.89 | 389.07 | 188 |
| 5 | 142.96 | 330.07 | 187 |
| 77 | 188.83 | 365.44 | 177 |
| 67 | 184.89 | 354.35 | 169 |
| urea104 | 157.41 | 322.31 | 165 |
| 30 | 167.55 | 325.49 | 158 |
| 81 | 157.48 | 311.3 | 154 |
| 165 | 234.51 | 386.33 | 152 |
| 108 | 131.77 | 277.94 | 146 |
| 96 | 136.85 | 282.62 | 146 |
| 242 | 145.15 | 290.03 | 145 |
| 179 | 126.79 | 270.66 | 144 |
| 65 | 141.1 | 281.88 | 141 |
| 49 | 137.46 | 271.59 | 134 |
| 158 | 226.68 | 357.1 | 130 |
| 75 | 198.96 | 327.74 | 129 |
| 205 | 166.31 | 290.27 | 124 |
| 188 | 140.51 | 264 | 123 |
| gst93 | 180.92 | 303.53 | 123 |
| 22 | 165.74 | 285.77 | 120 |
| 103 | 135.97 | 255.97 | 120 |
| 5 | 136.8 | 256.57 | 120 |
| gst78 | 166.6 | 280.92 | 114 |
| 101 | 145.42 | 256.97 | 112 |
| 97 | 161.53 | 272.37 | 111 |
| 99 | 142.55 | 252.24 | 110 |

TABLE 4K-continued

2894 (M6)

| GAS | preimm | imm | D mean |
|---|---|---|---|
| 249 | 154.21 | 260.33 | 106 |
| 99 | 155.11 | 259.89 | 105 |
| 63 | 183.32 | 288 | 105 |
| urea74 | 273.9 | 376.33 | 102 |
| 218 | 193.12 | 289.73 | 97 |
| 82 | 151.09 | 247.6 | 97 |
| 291 | 230.77 | 326.18 | 95 |
| 56 | 133.13 | 226.56 | 93 |
| 313 | 164.4 | 257.09 | 93 |
| gst62 | 213.44 | 301.49 | 88 |
| 29 | 146.63 | 232.54 | 86 |
| 195 | 146.49 | 229.21 | 83 |
| 69 | 169.17 | 251.36 | 82 |
| 117/40 | 116.48 | 191.3 | 75 |
| 40 native | 153.81 | 222.75 | 69 |
| 100 | 140.04 | 206.26 | 66 |
| 89 | 190.08 | 255.3 | 65 |
| 23 | 276.7 | 340.78 | 64 |
| urea207 | 235.8 | 298.53 | 63 |
| 117/40 | 308.59 | 370.9 | 62 |
| 327 | 162.83 | 219.35 | 57 |
| 206 | 207.34 | 262.2 | 55 |
| gst175 | 184.7 | 231.44 | 47 |
| 18 | 196.97 | 242.89 | 46 |
| gst68 | 185.03 | 226.78 | 42 |
| urea210 | 319.86 | 361.09 | 41 |
| 380 | 153.11 | 189.62 | 37 |
| 91 | 253.81 | 283.56 | 30 |
| urea131 | 388.76 | 401.45 | 13 |
| 92 | 228.84 | 228.61 | −0 |
| gst60 | 172.67 | 168.78 | −4 |
| 23 | 201.52 | 189.19 | −12 |
| 86 | 249.72 | 237.12 | −13 |
| 88 | 232.21 | 218.65 | −14 |
| 36 | 174.56 | 157.46 | −17 |
| gst94 | 357.68 | 320.75 | −37 |
| 25 | 409.14 | 359.62 | −50 |
| 219 | 279.52 | 199.04 | −80 |
| 105 | 354.27 | 258.84 | −95 |
| 208 | 249.85 | 99.36 | 50 |
| 187 | 518.52 | 256.39 | −262 |

TABLE 4L

3650 (M6)

| GAS | preimm | imm | D mean |
|---|---|---|---|
| 5 | 146.42 | 493.86 | 347 |
| 96 | 194.48 | 461.78 | 267 |
| 5 | 170.83 | 436.96 | 266 |
| 5 | 193.67 | 459.02 | 265 |
| 166 | 198.73 | 374.92 | 176 |
| 96 | 145.29 | 311.33 | 166 |
| 108 | 145.24 | 307.56 | 162 |
| 5 | 174.55 | 336.6 | 162 |
| 103 | 133.82 | 295.63 | 162 |
| 166 | 159.73 | 309.82 | 150 |
| 67 | 187.77 | 335.44 | 148 |
| 96 | 143.54 | 282.31 | 139 |
| 99 | 156.87 | 285.37 | 129 |
| 165 | 242.31 | 368.83 | 127 |
| 158 | 230.31 | 355.33 | 125 |
| 77 | 169.06 | 293.47 | 124 |
| 142 | 184.4 | 308.65 | 124 |
| 99 | 186.35 | 309.24 | 123 |
| 242 | 150.89 | 260.42 | 110 |
| 179 | 146.46 | 255.93 | 109 |
| 85 | 184.74 | 290.71 | 106 |
| 65 | 176.52 | 277.49 | 101 |
| 63 | 190.49 | 290.04 | 100 |
| 101 | 146.2 | 243.55 | 97 |

TABLE 4L-continued

3650 (M6)

| GAS | preimm | imm | D mean |
|---|---|---|---|
| urea104 | 183.51 | 278.91 | 95 |
| 75 | 205.16 | 293.63 | 88 |
| 49 | 143.02 | 228.44 | 85 |
| 100 | 156.63 | 240.89 | 84 |
| 30 | 177.71 | 259.73 | 82 |
| 188 | 162.5 | 243.73 | 81 |
| 99 | 216.69 | 293.47 | 77 |
| 327 | 166.96 | 242.38 | 75 |
| 190 | 113.74 | 188.14 | 74 |
| 81 | 167.4 | 241.78 | 74 |
| gst62 | 199.1 | 273.1 | 74 |
| 56 | 152.05 | 225.58 | 74 |
| gst78 | 190.66 | 260.53 | 70 |
| 206 | 202.02 | 270.02 | 68 |
| 195 | 160.32 | 225.37 | 65 |
| 18 | 201.92 | 265.78 | 64 |
| 142 | 180.11 | 242.07 | 62 |
| 380 | 152.3 | 213.67 | 61 |
| gst143 | 169.13 | 227.88 | 59 |
| 195 | 144.93 | 203.08 | 58 |
| 69 | 177.22 | 234.26 | 57 |
| 205 | 162.95 | 216.28 | 53 |
| 82 | 170.26 | 219.96 | 50 |
| gst93 | 184.97 | 234.59 | 50 |
| 249 | 158.28 | 204.93 | 47 |
| 76 | 197.51 | 243.79 | 46 |
| 40 native | 164.5 | 210.53 | 46 |
| gst6 | 182.47 | 227.05 | 45 |
| 178 | 148.92 | 193.29 | 44 |
| urea271 | 239.45 | 283.82 | 44 |
| 97 | 192.1 | 230.07 | 38 |
| 23 | 213.62 | 243.44 | 30 |
| 22 | 190.7 | 219.32 | 29 |
| 92 | 205.9 | 234.18 | 28 |
| 291 | 242.82 | 267.35 | 25 |
| 313 | 169.51 | 193.55 | 24 |
| 218 | 184.47 | 204.73 | 20 |
| 23 | 280.69 | 300.66 | 20 |
| 86 | 217.84 | 233.64 | 16 |
| gst175 | 175.99 | 190.91 | 15 |
| gst60 | 178.72 | 193.42 | 15 |
| 89 | 209.93 | 224.22 | 14 |
| urea74 | 214.59 | 228.03 | 13 |
| 36 | 188.1 | 198.97 | 11 |
| 219 | 210.94 | 211.99 | 1 |
| 29 | 134.98 | 133.36 | −2 |
| 91 | 238.68 | 235.25 | −3 |
| 88 | 212.52 | 206.02 | −7 |
| urea210 | 217.74 | 206.08 | 2 |
| gst123 | 186.58 | 173.22 | 3 |
| urea131 | 365.24 | 345.44 | −20 |
| gst68 | 188.41 | 162.3 | −26 |
| 25 | 383.59 | 355.37 | −28 |
| gst98 | 200.15 | 164.33 | −36 |
| gst94 | 281.97 | 228.52 | −53 |
| urea207 | 236 | 174.46 | −62 |
| 117/40 | 294.54 | 227.06 | −67 |
| 105 | 322.94 | 230.21 | −93 |
| 40/117 | 401.06 | 230.13 | 71 |
| 187 | 497.21 | 260.15 | −237 |

TABLE 4M

2725 (M8)

| GAS | preimm | imm | D mean |
|---|---|---|---|
| 117/40 | 119.7 | 361.05 | 241 |
| 117/40 | 129.54 | 366.6 | 237 |
| 40 native | 133.34 | 346.36 | 213 |
| 103 | 143.97 | 350.55 | 207 |
| 105 | 154.68 | 342.64 | 188 |

TABLE 4M-continued

2725 (M8)

| GAS | preimm | imm | D mean |
|---|---|---|---|
| 188 | 118.31 | 281.98 | 164 |
| 56 | 158.29 | 314.14 | 156 |
| 187 | 181.5 | 316.19 | 135 |
| 25 | 240.65 | 370.84 | 130 |
| 108 | 138.43 | 260.16 | 122 |
| 40/117 | 142.79 | 259.15 | 116 |
| 99 | 163.46 | 266.11 | 103 |
| 77 | 130.54 | 229.17 | 99 |
| gst94 | 156.84 | 253.22 | 96 |
| gst68 | 206.05 | 293.62 | 88 |
| 18 | 139.11 | 226.15 | 87 |
| 166 | 132.95 | 213.94 | 81 |
| urea131 | 200.54 | 279.46 | 79 |
| urea104 | 208.37 | 286.62 | 78 |
| 67 | 156.01 | 228.5 | 72 |
| gst123 | 188.09 | 259.19 | 71 |
| 96 | 156.69 | 227.47 | 71 |
| 249 | 150.34 | 215.57 | 65 |
| 5 | 134.04 | 195.64 | 62 |
| gst143 | 113.16 | 170.42 | 57 |
| 76 | 108.48 | 162.12 | 54 |
| gst93 | 111.11 | 164.58 | 53 |
| gst62 | 195.2 | 246.49 | 51 |
| 96 | 118.26 | 167.04 | 49 |
| 99 | 130.92 | 175.71 | 45 |
| 242 | 140 | 183.54 | 44 |
| 158 | 322.87 | 361.21 | 38 |
| 166 | 141.26 | 179.03 | 38 |
| 313 | 111.76 | 148.58 | 37 |
| 190 | 112 | 147.89 | 36 |
| 23 | 161.53 | 197.22 | 36 |
| 195 | 136.65 | 170.16 | 34 |
| 101 | 135.83 | 166.46 | 31 |
| 291 | 147.4 | 177.09 | 30 |
| 218 | 144.77 | 172.56 | 28 |
| gst98 | 204.99 | 231.92 | 27 |
| 219 | 110.3 | 136.17 | 26 |
| 142 | 149.82 | 175.07 | 25 |
| 22 | 111.55 | 136.38 | 25 |
| 5 | 135.66 | 158.73 | 23 |
| 92 | 118.72 | 140.78 | 22 |
| 75 | 113.07 | 135.09 | 22 |
| 29 | 132.66 | 154.11 | 21 |
| 69 | 116.56 | 137.57 | 21 |
| 178 | 117.93 | 137.5 | 20 |
| 49 | 154.54 | 173.45 | 19 |
| gst6 | 108.85 | 126.92 | 18 |
| 36 | 107.48 | 125.36 | 18 |
| 100 | 160.26 | 177.87 | 18 |
| 91 | 112.25 | 129.1 | 17 |
| 5 | 140.39 | 156.81 | 16 |
| 81 | 109.92 | 125.21 | 15 |
| 380 | 143.37 | 157.01 | 14 |
| gst78 | 109.56 | 121.56 | 12 |
| gst60 | 110.33 | 119.92 | 10 |
| 179 | 142.13 | 150.44 | 8 |
| 96 | 212.43 | 219.4 | 7 |
| 205 | 111.13 | 117.85 | 7 |
| 30 | 137.88 | 143.78 | 6 |
| 5 | 156.13 | 161.6 | 5 |
| 82 | 115.91 | 121.29 | 5 |
| 206 | 141.1 | 145.37 | 4 |
| 327 | 116.21 | 120.45 | 4 |
| 85 | 124.15 | 128.17 | 4 |
| 99 | 121.93 | 125.38 | 3 |
| 23 | 132.52 | 134.38 | 2 |
| 65 | 123.06 | 124.46 | 1 |
| 86 | 123.24 | 124.2 | 1 |
| 97 | 148.35 | 148.02 | −0 |
| 63 | 130.88 | 128.42 | −2 |
| 88 | 128.87 | 125.08 | −4 |
| 89 | 142.83 | 137.31 | −6 |
| 195 | 145.99 | 134.36 | 2 |
| urea210 | 341.21 | 320.62 | −21 |
| 142 | 142.04 | 115.27 | −27 |
| urea74 | 240.92 | 200.02 | −41 |
| urea271 | 334.19 | 252.53 | −82 |
| 165 | 301.17 | 218.36 | −83 |
| urea207 | 348.18 | 259.49 | −89 |
| gst175 | 240 | 110.44 | 30 |
| 208 | 335.19 | 185.85 | 49 |

TABLE 4N

2720 (M9)

| GAS | preimm | imm | D mean |
|---|---|---|---|
| 117/40 | 141.02 | 457.48 | 316 |
| 117/40 | 145.73 | 459.86 | 314 |
| 40/117 | 165.72 | 421.99 | 256 |
| 188 | 148.05 | 393.4 | 245 |
| 103 | 193.76 | 316.13 | 122 |
| 40 native | 139.6 | 257.15 | 118 |
| 67 | 195.71 | 309.91 | 114 |
| 190 | 148.58 | 258.46 | 110 |
| 56 | 195.41 | 302.64 | 107 |
| 105 | 199.31 | 299.11 | 100 |
| 76 | 144.96 | 239.8 | 95 |
| 5 | 140.99 | 234.64 | 94 |
| 108 | 194.22 | 278.09 | 84 |
| gst6 | 152.71 | 231.66 | 79 |
| 219 | 154.98 | 228.78 | 74 |
| gst62 | 155.74 | 227.55 | 72 |
| 249 | 179.3 | 249.93 | 71 |
| gst143 | 156.61 | 223.44 | 67 |
| gst94 | 159.33 | 222.14 | 63 |
| 96 | 134.8 | 196.78 | 62 |
| 96 | 161.74 | 219.43 | 58 |
| 142 | 183.78 | 239.61 | 56 |
| 22 | 147.85 | 203.36 | 56 |
| 166 | 183.15 | 238.61 | 55 |
| 18 | 161.74 | 216.84 | 55 |
| 69 | 155.21 | 209.87 | 55 |
| 36 | 140.97 | 195.19 | 54 |
| 166 | 180.38 | 234.07 | 54 |
| 81 | 144.72 | 197.76 | 53 |
| gst93 | 157.96 | 210.45 | 52 |
| 327 | 159.07 | 211.23 | 52 |
| 242 | 180.72 | 231.33 | 51 |
| 5 | 142.32 | 192.3 | 50 |
| 77 | 158.26 | 206.73 | 48 |
| 75 | 149.1 | 195.09 | 46 |
| gst60 | 158.26 | 202.34 | 44 |
| 313 | 164.87 | 207.49 | 43 |
| 29 | 165.78 | 208.37 | 43 |
| 178 | 153.97 | 196.08 | 42 |
| 85 | 150.83 | 192.41 | 42 |
| 23 | 159.35 | 200.37 | 41 |
| 5 | 194.91 | 232.58 | 38 |
| 218 | 170.82 | 208.14 | 37 |
| 142 | 190.44 | 226.92 | 36 |
| 101 | 195.32 | 231.76 | 36 |
| 195 | 200.27 | 236.02 | 36 |
| 5 | 161.19 | 196.51 | 35 |
| gst68 | 193.71 | 228.96 | 35 |
| gst123 | 200.92 | 235.71 | 35 |
| 205 | 164.46 | 199.19 | 35 |
| 97 | 169.12 | 202.91 | 34 |
| 99 | 133.4 | 165.99 | 33 |
| 63 | 158.28 | 189.81 | 32 |
| 99 | 200.88 | 231.43 | 31 |
| 91 | 175.71 | 204.73 | 29 |
| 291 | 165.4 | 193.78 | 28 |
| 99 | 145.56 | 173.44 | 28 |
| 206 | 148.07 | 172.25 | 24 |
| 92 | 188.4 | 207.68 | 19 |

TABLE 4N-continued

2720 (M9)

| GAS | preimm | imm | D mean |
|---|---|---|---|
| 25 | 323.41 | 342.29 | 19 |
| gst78 | 159.86 | 178.6 | 19 |
| 100 | 159.03 | 176.45 | 17 |
| 82 | 171.61 | 186.09 | 14 |
| 89 | 159.72 | 174.07 | 14 |
| 30 | 169.35 | 182.78 | 13 |
| gst98 | 199.05 | 211.94 | 13 |
| 187 | 276.98 | 289.86 | 13 |
| 65 | 145.41 | 156.44 | 11 |
| 23 | 147.37 | 158.25 | 11 |
| 49 | 180.46 | 190.17 | 10 |
| urea104 | 215.48 | 225 | 10 |
| 179 | 171.29 | 180.75 | 9 |
| 195 | 195.69 | 204.26 | 9 |
| urea131 | 195.32 | 202.88 | 8 |
| 158 | 254.04 | 252.18 | −2 |
| 86 | 203.55 | 198.07 | −5 |
| 380 | 227.51 | 221.75 | −6 |
| urea210 | 254.72 | 245.63 | −9 |
| 88 | 202.8 | 187.02 | 6 |
| 165 | 252.45 | 224.98 | −27 |
| urea74 | 216.05 | 170.45 | −46 |
| urea271 | 271.47 | 218.87 | −53 |
| 96 | 258.44 | 203.18 | −55 |
| urea207 | 273.74 | 213.67 | −60 |
| 208 | 271.52 | 179.66 | −92 |
| gst175 | 230.39 | 119.02 | 11 |

TABLE 4O

2727 (M11)

| GAS | preimm | imm | D mean |
|---|---|---|---|
| 187 | 140.08 | 317.29 | 177 |
| 188 | 118.52 | 285.5 | 167 |
| 190 | 120.67 | 272.78 | 152 |
| gst68 | 110.12 | 221.3 | 111 |
| 142 | 110.78 | 215.59 | 105 |
| 25 | 128.41 | 231.82 | 103 |
| 99 | 108.65 | 206.18 | 98 |
| 96 | 113.81 | 207.75 | 94 |
| 40 native | 130.45 | 219.92 | 89 |
| 103 | 109.6 | 187.48 | 78 |
| 291 | 106.95 | 184.41 | 77 |
| 208 | 137.32 | 213.53 | 76 |
| gst143 | 117.64 | 191.02 | 73 |
| 5 | 109 | 178.51 | 70 |
| 195 | 115.93 | 181.44 | 66 |
| 179 | 109.29 | 171.37 | 62 |
| 91 | 116.4 | 175.37 | 59 |
| gst60 | 113.66 | 171.71 | 58 |
| 206 | 126.96 | 183.01 | 56 |
| 117-40 | 114.35 | 170.1 | 56 |
| 77 | 126.88 | 179.9 | 53 |
| 56 | 110.53 | 162.41 | 52 |
| 99 | 121.25 | 172.91 | 52 |
| 142 | 108.23 | 159.4 | 51 |
| 5 | 125.9 | 175.69 | 50 |
| 88 | 124.25 | 171.66 | 47 |
| 166 | 109.18 | 155.79 | 47 |
| 85 | 127.34 | 171.98 | 45 |
| 218 | 107.96 | 150.44 | 42 |
| 327 | 117.91 | 159.29 | 41 |
| 23 | 112.83 | 153.62 | 41 |
| 313 | 117.46 | 156.32 | 39 |
| 76 | 115.83 | 154.67 | 39 |
| 105 | 136.05 | 171.93 | 36 |
| gst93 | 119.6 | 153.62 | 34 |
| 96 | 124.82 | 158.27 | 33 |
| 380 | 109.15 | 141.7 | 33 |
| urea271 | 127.42 | 159.06 | 32 |

TABLE 4O-continued

2727 (M11)

| GAS | preimm | imm | D mean |
|---|---|---|---|
| 69 | 122.08 | 152.38 | 30 |
| 249 | 108.85 | 138.01 | 29 |
| 65 | 128.86 | 157.38 | 29 |
| 36 | 112.53 | 141 | 28 |
| 29 | 114.25 | 142.13 | 28 |
| 97 | 125.05 | 152.44 | 27 |
| 67 | 110.84 | 138.14 | 27 |
| gst175 | 108.81 | 135.59 | 27 |
| 92 | 120.63 | 146.68 | 26 |
| 158 | 114.09 | 139.35 | 25 |
| 22 | 118.34 | 142.91 | 25 |
| 166 | 110.16 | 133.3 | 23 |
| 86 | 121.27 | 144.27 | 23 |
| 89 | 130.95 | 152.72 | 22 |
| 5 | 134.47 | 156 | 22 |
| gst78 | 123.05 | 144.55 | 22 |
| gst6 | 115.84 | 136.22 | 20 |
| gst94 | 110.3 | 129.83 | 20 |
| 108 | 110.33 | 128.88 | 19 |
| 81 | 116.42 | 134.69 | 18 |
| 242 | 109.07 | 125.55 | 16 |
| 63 | 125.89 | 142.04 | 16 |
| 30 | 121.28 | 136.18 | 15 |
| urea131 | 114.53 | 129.05 | 15 |
| 5 | 134.59 | 148.71 | 14 |
| 75 | 116.08 | 130.14 | 14 |
| gst123 | 108.56 | 121.85 | 13 |
| urea104 | 113.37 | 126.08 | 13 |
| 195 | 108.57 | 119.53 | 11 |
| 219 | 117.54 | 127.94 | 10 |
| 100 | 106.44 | 115.69 | 9 |
| 82 | 120.43 | 129.57 | 9 |
| 49 | 107.09 | 115.98 | 9 |
| 205 | 121.35 | 130.04 | 9 |
| 18 | 107.52 | 114.29 | 7 |
| 101 | 109.29 | 116.03 | 7 |
| gst62 | 116.1 | 122.71 | 7 |
| 99 | 109.33 | 112.71 | 3 |
| urea207 | 114.74 | 117.31 | 3 |
| gst98 | 115.38 | 117.54 | 2 |
| 96 | 114.2 | 115.91 | 2 |
| 23 | 120.21 | 121.22 | 1 |
| 165 | 113.41 | 113.93 | 1 |
| urea74 | 122.75 | 122.87 | 0 |
| urea210 | 148.43 | 145.97 | −2 |

TABLE 4P

2728 (M12)

| GAS | preimm | imm | D mean |
|---|---|---|---|
| gst94 | 251.84 | 680.42 | 429 |
| 142 | 338.89 | 734.89 | 396 |
| 195 | 336.24 | 657.87 | 322 |
| 206 | 183.39 | 503.53 | 320 |
| 91 | 215.56 | 526.39 | 311 |
| 117/40 | 301.43 | 593.03 | 292 |
| 86 | 237.22 | 494.71 | 257 |
| 179 | 348.77 | 604.7 | 256 |
| gst93 | 206.33 | 459.47 | 253 |
| 108 | 285.59 | 522.09 | 237 |
| 5 | 394.13 | 617.66 | 224 |
| 249 | 346.58 | 563.49 | 217 |
| gst123 | 276.94 | 486.97 | 210 |
| 92 | 177.33 | 379.12 | 202 |
| 327 | 182.42 | 383.27 | 201 |
| 195 | 387.46 | 582.58 | 195 |
| 166 | 320.52 | 513.12 | 193 |
| 40/117 | 378.99 | 568.74 | 190 |
| 5 | 142.19 | 330.38 | 188 |
| 205 | 188.72 | 376.65 | 188 |

TABLE 4P-continued

2728 (M12)

| GAS | preimm | imm | D mean |
|---|---|---|---|
| 103 | 260.61 | 443.88 | 183 |
| gst68 | 276.36 | 458.41 | 182 |
| 29 | 443.15 | 619.08 | 176 |
| 89 | 214.67 | 386.61 | 172 |
| 190 | 159.65 | 325.96 | 166 |
| 165 | 330.05 | 492.13 | 162 |
| urea131 | 242.23 | 394.87 | 153 |
| 99 | 242.7 | 389.56 | 147 |
| 291 | 317.66 | 462.75 | 145 |
| 25 | 403.44 | 545.75 | 142 |
| 22 | 197.09 | 327.2 | 130 |
| 36 | 174.89 | 304.42 | 130 |
| 142 | 396.87 | 515.19 | 118 |
| gst62 | 263.34 | 381.18 | 118 |
| 242 | 314.13 | 424.94 | 111 |
| 69 | 211.17 | 321.93 | 111 |
| 166 | 411.87 | 518.49 | 107 |
| 77 | 162.29 | 264.68 | 102 |
| gst98 | 236.21 | 333.27 | 97 |
| 218 | 404.99 | 497.96 | 93 |
| 76 | 159.37 | 251.91 | 93 |
| 23 | 238.76 | 325.36 | 87 |
| 30 | 181.8 | 266.09 | 84 |
| 96 | 382.18 | 465.7 | 84 |
| gst6 | 189.43 | 269.12 | 80 |
| 40 native | 389.93 | 469 | 79 |
| 380 | 272.74 | 351.3 | 79 |
| 88 | 223.66 | 297.18 | 74 |
| 219 | 171.87 | 242.53 | 71 |
| gst78 | 204.47 | 268.61 | 64 |
| 117/40 | 323.77 | 386.97 | 63 |
| 96 | 244.24 | 305.7 | 61 |
| 81 | 195.87 | 256.82 | 61 |
| 18 | 202.14 | 259.92 | 58 |
| urea207 | 328.03 | 385.04 | 57 |
| 5 | 153.34 | 206.87 | 54 |
| 158 | 275.34 | 326.03 | 51 |
| 67 | 420.95 | 468.25 | 47 |
| 97 | 174.29 | 220.69 | 46 |
| 82 | 212.48 | 255.68 | 43 |
| urea74 | 316.31 | 357.5 | 41 |
| 75 | 189.81 | 227.98 | 38 |
| 100 | 217.94 | 253.84 | 36 |
| gst143 | 196.9 | 232.63 | 36 |
| 188 | 178.03 | 208.6 | 31 |
| 63 | 176.05 | 206.46 | 30 |
| 313 | 178.37 | 201.14 | 23 |
| 208 | 348.19 | 368.12 | 20 |
| 49 | 228.91 | 245.51 | 17 |
| 101 | 348.39 | 363.93 | 16 |
| 5 | 175.01 | 183.36 | 8 |
| 65 | 172.37 | 178.02 | 6 |
| 99 | 370.31 | 375.14 | 5 |
| 85 | 170.05 | 174.72 | 5 |
| urea210 | 400.11 | 404.21 | 4 |
| 23 | 154.14 | 155.97 | 2 |
| 99 | 158.02 | 156.91 | |
| 96 | 155.2 | 150.51 | −5 |
| 187 | 440.44 | 430.29 | 0 |
| gst60 | 217.51 | 203.6 | 4 |
| urea271 | 444.89 | 373.82 | −71 |
| 105 | 473.03 | 380.39 | −93 |
| 56 | 284.4 | 180.93 | 03 |
| 178 | 518.6 | 407.23 | 11 |
| urea104 | 463.47 | 337.94 | 26 |
| gst175 | 401.85 | 125.16 | −277 |

TABLE 4Q

DSM 2071 (M23)

| GAS | preimm | imm | D mean |
|---|---|---|---|
| 67 | 128.35 | 359.3 | 231 |
| 166 | 124.38 | 326.64 | 202 |
| 190 | 125.36 | 315.81 | 190 |
| gst60 | 121.15 | 276.58 | 155 |
| 103 | 114.95 | 231.03 | 116 |
| 142 | 118.53 | 234.37 | 116 |
| 29 | 116.02 | 223.84 | 108 |
| 291 | 121.62 | 215.87 | 94 |
| gst6 | 125.51 | 211.9 | 86 |
| 313 | 122.76 | 202.26 | 80 |
| 56 | 127.35 | 201.01 | 74 |
| 380 | 115.41 | 180.08 | 65 |
| 97 | 137.33 | 200.6 | 63 |
| 96 | 169.18 | 229.08 | 60 |
| 99 | 125.69 | 184.5 | 59 |
| gst78 | 129.66 | 188.11 | 58 |
| 23 | 119.91 | 177.68 | 58 |
| 188 | 132.06 | 188.54 | 56 |
| gst68 | 118.31 | 174.37 | 56 |
| 206 | 162.71 | 216.36 | 54 |
| 91 | 127.52 | 179.67 | 52 |
| urea104 | 128.64 | 180.29 | 52 |
| 89 | 150.16 | 200.54 | 50 |
| gst175 | 120.66 | 171.02 | 50 |
| 81 | 134.57 | 182.95 | 48 |
| 88 | 125.63 | 173.6 | 48 |
| 166 | 123.8 | 171.21 | 47 |
| gst93 | 130.31 | 176.42 | 46 |
| 117-40 | 132.35 | 177.38 | 45 |
| 99 | 153.44 | 198.42 | 45 |
| 195 | 137 | 179.72 | 43 |
| 96 | 138.79 | 180.84 | 42 |
| 242 | 137.11 | 177.52 | 40 |
| 92 | 127.34 | 165.99 | 39 |
| 22 | 128.37 | 166.75 | 38 |
| 195 | 117.66 | 154.18 | 37 |
| 40 native | 192.07 | 228.3 | 36 |
| 205 | 130.34 | 166.16 | 36 |
| 23 | 149.18 | 183.91 | 35 |
| gst62 | 126.42 | 160.49 | 34 |
| 165 | 136.68 | 170.31 | 34 |
| gst143 | 131.51 | 164.59 | 33 |
| 86 | 126.07 | 158.41 | 32 |
| 101 | 113.82 | 145.37 | 32 |
| 5 | 153.64 | 184.82 | 31 |
| 99 | 127.62 | 158.78 | 31 |
| 77 | 149.48 | 179.87 | 30 |
| 82 | 124.97 | 154.96 | 30 |
| 18 | 124.84 | 154.58 | 30 |
| 69 | 117.82 | 146.47 | 29 |
| 158 | 151.39 | 178.9 | 28 |
| urea271 | 141.04 | 168.16 | 27 |
| 5 | 117.67 | 144.56 | 27 |
| 249 | 131.83 | 158.42 | 27 |
| 85 | 160.45 | 186.93 | 26 |
| gst94 | 122.06 | 148.04 | 26 |
| urea131 | 147.64 | 172.92 | 25 |
| 5 | 143.5 | 168.5 | 25 |
| 25 | 130 | 154.87 | 25 |
| 76 | 121.55 | 144.69 | 23 |
| 100 | 118.11 | 140.17 | 22 |
| 65 | 148.35 | 170.11 | 22 |
| gst98 | 125.6 | 147.13 | 22 |
| urea74 | 140.84 | 161.11 | 20 |
| 5 | 184.82 | 205.08 | 20 |
| 96 | 125.15 | 144.29 | 19 |
| 75 | 127.09 | 145.9 | 19 |
| 219 | 127.33 | 144.11 | 17 |
| 30 | 149.61 | 165.06 | 15 |
| 327 | 127.95 | 142.74 | 15 |
| 49 | 124.67 | 136.44 | 12 |
| 179 | 121.78 | 133.02 | 11 |
| 63 | 163.28 | 173.73 | 10 |
| gst123 | 139.21 | 149.4 | 10 |
| 36 | 127.54 | 136.23 | 9 |

TABLE 4Q-continued

DSM 2071 (M23)

| GAS | preimm | imm | D mean |
|---|---|---|---|
| urea207 | 139.53 | 145 | 5 |
| 218 | 127.08 | 126.81 | −0 |
| urea210 | 202.86 | 194.93 | −8 |
| 105 | 192.62 | 181.45 | 1 |
| 208 | 163.58 | 145.96 | 8 |
| 142 | 179.95 | 136.43 | −44 |
| 187 | 217.14 | 165.85 | −51 |
| 108 | 336.37 | 249.51 | −87 |

TABLE 4R

HYPOCAPSULATED (M23)

| GAS | preimm | imm | D mean |
|---|---|---|---|
| 166 | 147.07 | 320.25 | 173 |
| 166 | 115.19 | 287.83 | 173 |
| 5 | 165.76 | 307.64 | 142 |
| 89 | 174.86 | 292.62 | 118 |
| 96 | 168.28 | 280.46 | 112 |
| 103 | 110.55 | 216.99 | 106 |
| 158 | 139.81 | 230.42 | 91 |
| 40 native | 147.21 | 223.64 | 76 |
| gst60 | 127.79 | 202.72 | 75 |
| 23 | 160.79 | 233.16 | 72 |
| 97 | 168.83 | 239.57 | 71 |
| 77 | 153.6 | 224.28 | 71 |
| 67 | 113.23 | 176.15 | 63 |
| 5 | 174.46 | 233.28 | 59 |
| 99 | 174.53 | 226.03 | 52 |
| 30 | 171.57 | 219.07 | 48 |
| 5 | 178.58 | 224.21 | 46 |
| 108 | 108.5 | 152.72 | 44 |
| gst68 | 114.55 | 153.63 | 39 |
| 249 | 127.45 | 166.15 | 39 |
| 117-40 | 115.85 | 153.66 | 38 |
| 291 | 119.47 | 156.88 | 37 |
| 22 | 117.77 | 149.66 | 32 |
| 65 | 158.28 | 189.33 | 31 |
| gst143 | 118.08 | 148.26 | 30 |
| 56 | 113.9 | 144 | 30 |
| gst175 | 113.63 | 142.1 | 28 |
| 75 | 113.43 | 141.09 | 28 |
| 63 | 164.81 | 191.66 | 27 |
| 188 | 112.28 | 138.93 | 27 |
| 81 | 108.59 | 135.07 | 26 |
| urea104 | 115.9 | 142.18 | 26 |
| gst94 | 110.32 | 135.77 | 25 |
| 380 | 117.06 | 140.96 | 24 |
| gst93 | 116.03 | 139 | 23 |
| 142 | 123.42 | 145.26 | 22 |
| urea74 | 126.25 | 147.41 | 21 |
| 76 | 114.73 | 133.92 | 19 |
| 25 | 177.41 | 196.44 | 19 |
| 105 | 135.7 | 153.54 | 18 |
| gst6 | 111.86 | 129.37 | 18 |
| 85 | 169.93 | 186.43 | 17 |
| gst62 | 122.14 | 137.32 | 15 |
| 99 | 114.17 | 127.97 | 14 |
| 18 | 106.85 | 120.35 | 14 |
| 190 | 128.79 | 140.94 | 12 |
| 242 | 111.36 | 122.31 | 11 |
| 195 | 109.23 | 119.63 | 10 |
| 69 | 118.95 | 128.27 | 9 |
| 218 | 114.25 | 123.24 | 9 |
| 205 | 131.65 | 140.25 | 9 |
| 36 | 113.81 | 121.64 | 8 |
| gst123 | 115.49 | 122.73 | 7 |
| 92 | 131.82 | 139.05 | 7 |

TABLE 4R-continued

HYPOCAPSULATED (M23)

| GAS | preimm | imm | D mean |
|---|---|---|---|
| 29 | 115.59 | 122.77 | 7 |
| 101 | 114.03 | 118.95 | 5 |
| gst98 | 109.62 | 114.26 | 5 |
| 23 | 103.38 | 107.36 | 4 |
| 165 | 153.83 | 157.05 | 3 |
| 99 | 103.32 | 105.76 | 2 |
| 96 | 116.94 | 119.33 | 2 |
| 5 | 108.81 | 110.82 | 2 |
| 88 | 135.87 | 136.8 | 1 |
| 206 | 155.86 | 155.67 | −0 |
| urea131 | 140.85 | 140.3 | |
| 313 | 128.87 | 127.82 | |
| 82 | 136.42 | 133.65 | −3 |
| 219 | 113.18 | 110.38 | −3 |
| gst78 | 120.15 | 117.09 | −3 |
| 142 | 107.3 | 103.71 | −4 |
| 49 | 108.29 | 104.42 | −4 |
| 179 | 122.91 | 115.04 | −8 |
| 195 | 114.49 | 105.38 | −9 |
| 91 | 133.5 | 123.34 | 0 |
| 86 | 158.27 | 147.33 | 1 |
| 96 | 118.41 | 106.12 | 2 |
| 100 | 114.44 | 100.4 | 4 |
| 327 | 128.8 | 110.11 | 9 |
| 187 | 190.7 | 170.46 | −20 |
| urea271 | 154.79 | 128.67 | −26 |
| urea207 | 170.88 | 122.57 | −48 |
| urea210 | 299.43 | 236.67 | −63 |
| 208 | 247.37 | 167.41 | −80 |

TABLE 5

Percent identity of GAS40 proteins compared to reference strain SF370 (M1)

| Strain | nucleotide differences | amino acid differences | M type | % identity |
|---|---|---|---|---|
| 3280 | 0 | 0 | 1 | 100 |
| 3789 | 0 | 0 | 78 | 100 |
| 3348 | 0 | 0 | 1 | 100 |
| 2913 | 0 | 0 | 1 | 100 |
| 2580 | 0 | 0 | 1 | 100 |
| 2719 | 0 | 0 | 1 | 100 |
| 4959 | 9 | 3 | 77 | 100 |
| 2722 | 5 | 2 | 4 | 100 |
| 2894 | 10 | 4 | 6 | 100 |
| 3776 | 8 | 4 | 44 | 99.6 |
| 3650 | 11 | 4 | 6 | 99.6 |
| 5529 | 10 | 4 | 6 | 99.6 |
| 2728 | 9 | 5 | 4 | 99.5 |
| 2725 | 9 | 5 | 8 | 99.5 |
| 2720 | 9 | 4 | 9 | 99.5 |
| 2724 | 7 | 4 | 6 | 99.5 |
| DSM2071 | 12 | 5 | 23 | 99.4 |
| 2634 | 12 | 6 | 1 | 99.4 |
| 4436 | 10 | 5 | 28 | 99.4 |
| 4883 | 13 | 5 | 5 | 99.4 |
| 5481 | 13 | 5 | 44 | 99.4 |
| 5476 | 10 | 4 | 89 | 99.4 |
| 4538 | 21 | 6 | 50 | 99.3 |
| 5455 | 21 | 6 | 62 | 99.3 |
| 2721 | 23 | 8 | 3 | 99.3 |
| 3040 | 23 | 7 | 3 | 99.2 |
| 5531 | 17 | 8 | 75 | 99.2 |
| 4088 | 15 | 7 | ND | 99.2 |
| 3135 | 22 | 8 | 3 | 99.2 |
| 2727 | 19 | 9 | 11 | 99.0 |
| 2726 | 101 | 25 | 2 | 95.9 |

TABLE 6A

Survival rate 7 days post-infection

| Group | 1 | 2 | 3 | 4 | 5 | 6 | 7 | Fatalities | total mice | % survival | strain | cfu/topo | |
|---|---|---|---|---|---|---|---|---|---|---|---|---|---|
| 1 | 0 | 7 | 2 | 0 | 0 | 0 | 0 | 9 | 10 | 10 | 2071 | 30 | HIS stop |
| 2 | 0 | 1 | 2 | 0 | 0 | 0 | 0 | 9 | 9 | 66 | 2071 | 30 | M23 |
| 3 | 0 | 4 | 1 | 0 | 0 | 0 | 0 | 5 | 10 | 50 | 2071 | 30 | 40N (SEQ ID NO: 930) |

TABLE 6B

Survival rate 7 days post-infection

| Group | 1 | 2 | 3 | 4 | 5 | 6 | 7 | Fatalities | total mice | % survival | strain | cfu/topo | |
|---|---|---|---|---|---|---|---|---|---|---|---|---|---|
| 1 | 0 | 0 | 7 | 0 | 0 | 0 | 0 | 7 | 10 | 30 | 2071 | 30 | HIS stop |
| 2 | 0 | 0 | 0 | 0 | 0 | 0 | 0 | 0 | 10 | 100 | 2071 | 30 | M23 |
| 3 | 0 | 0 | 2 | 0 | 0 | 0 | 0 | 2 | 10 | 80 | 2071 | 30 | 40N (SEQ ID NO: 930) |

TABLE 7

GAS proteins identified after protease digestion of the bacterial cell surface (LPXTG, SEQ ID NO: 931; RGD LPXTG, SEQ ID NO: 932)

| GAS | SPY | M1 = 1697 | PSORT prediction | TMD | Features | Description | FACS response (SF370) | Free trypsin | Free prot. K | Immob. prot. K | Immob. trypsin |
|---|---|---|---|---|---|---|---|---|---|---|---|
| 4 | spy0015 | gi-15674261 | membrane | 1 | | putative cell division protein | Negative | x | | | |
| 5 | spy0019 | gi-15674263 | outside | 0 | | putative secreted protein | Positive | | | | x |
| 15 | NA | gi-23503478 | | 2 | LPXTG | collagen binding protein | Positive | | x | | |
| 16 | spy0128 | gi-15674343 | membrane | 1 | | hypothetical protein | Positive | | x | | |
| 23 | spy0163 | gi-15674368 | | | lipoprotein | putative ABC transporter (lipoprotein) | ND | x | | | |
| 24 | spy0165 | gi-15674370 | secreted | 1 | | nicotine adenine dinucleotide glycohydrolase precursor | Positive | | x | x | |
| 25 | spy0167 | gi-15674372 | | | outside | streptolysin O precursor | ND | x | | | x |
| 40 | spy0269 | gi-15674449 | membrane | 2 | | putative surface exclusion protein | Positive | x | | | |
| 49 | spy0317 | gi-15674482 | lipoprotein | 0 | lipoprotein | conserved hypothetical protein | Positive | | x | | |
| 54 | spy0351 | gi-15674505 | lipoprotein | 3 | lipoprotein | hypothetical protein | ND | x | | | |
| 57 | spy0416 | gi-15674549 | cell wall | 1 | LPXTG | putative cell envelope proteinase | Positive | x | x | | |
| 63 | spy0457 | gi-15674576 | lipoprotein | 0 | lipoprotein | putative cyclophilin-type protein | Positive | | | | x |
| 64 | | gi-15674586 | secreted | 0 | | putative 42 kDa protein | Positive | x | x | | |
| 68 | | gi-15674788 | membrane | 2 | LPXTG | putative extracellular matrix binding protein | Positive | x | | | |
| 72 | | gi-15674925 | membrane | 1 | | putative ABC transporter (binding protein) | Positive | x | | | |
| 84 | | gi-15675229 | lipoprotein | 0 | lipoprotein | putative amino acid ABC transporter, periplasmic am | Positive | x | | x | |
| 86 | | gi-15675247 | lipoprotein | 0 | lipoprotein | putative maltose/maltodextrin-binding protein | Positive | x | | | |
| 87 | | gi-15675254 | | 0 | outside - RGD | putative cyclomaltodextrin glucanotransferase | ND | | | | x |

TABLE 7-continued

GAS proteins identified after protease digestion of the bacterial cell surface (LPXTG, SEQ ID NO: 931; RGD LPXTG, SEQ ID NO: 932)

| GAS | SPY | M1 = 1697 | PSORT prediction | TMD | Features | Description | FACS response (SF370) | Free trypsin | Free prot. K | Immob. prot. K | Immob. trypsin |
|---|---|---|---|---|---|---|---|---|---|---|---|
| 89 | | gi-15675314 | lipoprotein | 0 | lipoprotein | putative protease maturation protein | Positive | x | | | |
| 98 | | gi-15675700 | lipoprotein | 0 | lipoprotein | putative acid phosphatase | Positive | x | x | | |
| 102 | | gi-15675798 | | | outside | inhibitor of complement-mediated lysis | ND | | | | x |
| 103 | | gi-15675810 | lipoprotein | 0 | lipoprotein | conserved hypothetical | Positive | x | | | |
| 108 | | gi-15674686 | lipoprotein | 0 | lipoprotein | hypothetical protein | Positive | | | | x |
| 143 | | gi-15674798 | cell wall | 2 | RGDLPXTG | conserved hypothetical protein | Positive | x | x | x | |
| 149 | | gi-15674825 | membrane | 1 | | putative large conductance mechanosensitive channel | Positive | x | | | |
| 152 | spy0802 | gi-15674844 | membrane | 1 | | hypothetical protein | Negative | | x | | |
| 157 | spy0836 | gi-15674871 | membrane | 1 | | conserved hypothetical protein | Positive | | | x | |
| 158 | spy0843 | gi-15674877 | cell wall | 1 | | hypothetical protein | Positive | x | | | |
| 163 | spy1154 | gi-15675130 | membrane | 2 | | hypothetical protein | Positive | x | x | | x |
| 166 | spy1357 | gi-15675290 | cell wall | 1 | LPXTG | protein GRAB (protein G-related alpha 2M-binding protein) | Positive | x | | | |
| 168 | spy1370 | gi-15675302 | membrane | 1 | | putative deacetylase | ND | | | | x |
| 171 | spy1494 | gi-15675398 | cell wall | 1 | LPXTG | hypothetical protein | ND | x | x | | |
| 177 | spy1649 | gi-15675521 | membrane | 1 | | putative penicillin-binding protein 1a | Positive | | | | x |
| 188 | spy1983 | gi-15675773 | cell wall | 1 | LPXTG | collagen-like surface protei | Positive | x | x | | |
| 190 | spy2009 | gi-15675795 | cell wall | 1 | LPXTG | hypothetical protein | Positive | x | x | | |
| 191 | spy2010 | gi-15675796 | cell wall | 1 | RGDLPXTG | C5A peptidase precursor | Positive | x | x | | |
| 192 | spy2018 | gi-15675799 | cell wall | 2 | LPXTG | M protein type 1 | Positive | x | x | x | |
| 193 | spy2025 | gi-15675802 | membrane | 1 | | immunogenic secreted protein precursor | Negative | x | | | |
| 194 | spy2032 | gi-15675807 | | 1 | membrane | putative ATP-binding cassette transporter-like protein | ND | x | | | |
| 195 | spy2043 | gi-15675815 | | 1 | membrane | mitogenic factor | ND | | | | x |
| 198 | spy2184 | gi-15675919 | membrane | 2 | | conserved hypothetical protein | Negative | x | | | |
| 201 | spy2216 | gi-15675945 | membrane | 1 | | putative serine protease | Positive | x | | | |
| 224 | spy1044 | gi-15675040 | membrane | 2 | | hypothetical protein | ND | | | x | |
| 251 | spy1520 | gi-15675420 | membrane | 1 | | putative cell division protein | Positive | x | | | |
| 259 | spy1586 | gi-15675473 | membrane | 1 | | putative beta-galactosidase | ND | x | | | |
| 262 | spy1643 | gi-15675516 | membrane | 1 | | hypothetical protein | ND | x | | | |
| 264 | spy1686 | gi-15675546 | membrane | 1 | | hypothetical protein | ND | x | | | |
| 268 | spy1798 | gi-15675635 | | 1 | membrane | hypothetical protein sharing similarity with severa | ND | x | | | |
| 277 | spy1939 | gi-15675742 | membrane | 1 | | hypothetical protein | Positive | x | | | |
| 282 | spy2033 | gi-15675808 | membrane | 1 | | hypothetical protein | Positive | x | x | | |
| 299 | spy1188 | gi-15675157 | membrane | 1 | | putative citrate lyase, beta subunit | ND | x | | | |
| 382 | spy1842 | gi-15675668 | | 1 | membrane | putative signal peptidase I | ND | x | | | |
| 405 | spy1028 | gi-15675026 | membrane | 1 | | putative acetoin dehydrogenase (TPP-dependent) beta | Positive | x | | | |
| 406 | spy1031 | gi-15675028 | membrane | 1 | | putative dihydrolipoamide dehydrogenase, component | Positive | x | | | |
| 425 | spy0184 | gi-15674389 | membrane | 6 | | putative glycine-betaine binding permease protein | Positive | | | | x |
| 433 | spy0277 | gi-15674455 | cell wall | 3 | | putative glutamine-binding periplasmic protein | Positive | x | | | |
| 460 | spy0572 | gi-15674662 | membrane | 7 | | beta-glucoside permease IIABC component | ND | | x | | |
| 469 | spy0645 | gi-15674715 | membrane | 4 | | putative cell-division protein | ND | x | | | |

TABLE 7-continued

GAS proteins identified after protease digestion of the bacterial cell surface (LPXTG, SEQ ID NO: 931; RGD LPXTG, SEQ ID NO: 932)

| GAS | SPY | M1 = 1697 | PSORT prediction | TMD | Features | Description | FACS response (SF370) | Free trypsin | Free prot. K | Immob. prot. K | Immob. trypsin |
|---|---|---|---|---|---|---|---|---|---|---|---|
| 493 | spy0743 | gi-15674794 | membrane | 6 | | hypothetical protein | ND | | | x | |
| 500 | spy1410 | gi-15675330 | membrane | 2 | | putative 1-acylglycerol-3-phosphate O-acyltransferase | ND | x | | | |
| 545 | spy1740 | gi-15675589 | membrane | 3 | | putative mannose-specific phosphotransferase system | ND | x | | | |
| 558 | spy1109 | gi-15675091 | membrane | 10 | | putative L-malate permease | ND | | | x | |
| 587 | spy1315 | gi-15675263 | membrane | 4 | | hypothetical protein | ND | x | | | |
| 645 | spy2029 | gi-15675805 | membrane | 4 | | putative ABC transporter (ATP-binding protein) | ND | x | x | | |
| 650 | spy2120 | gi-15675870 | | 11 | membrane | putative integral membrane protein | ND | | | | |
| 685 | spy0319 | gi-15674483 | lipoprotein | 0 | | conserved hypothetical protein | Positive | x | | | |
| 362-1 | spy1461 | gi-15675369 | secreted | 0 | | hypothetical protein | Positive | x | | | |
| NS | spy0080a | gi-15675947 | | | | ribosomal protein L17 | ND | | | | |
| NS | spy0272 | gi-15674451 | | | | 30S ribosomal protein S7 | ND | | | | |
| NS | spy0461 | gi-15674580 | | | | 50S ribosomal protein L1 | ND | | | | |
| NS | spy0611 | gi-15674691 | cytoplasm | | | putative translation elongation factor EF-Tu | ND | x | x | | |
| NS | spy0717 | gi-15674775 | cytoplasm | | | 50S ribosomal protein L31 | ND | x | | | |
| NS | spy0792 | gi-15674835 | cytoplasm | | | conserved hypothetical protein - possibly involved in cell wall localization and side chain formation | ND | | | x | |
| NS | spy1029 | gi-15675027 | | | | putative dihydrolipoamide S-acetyltransferase | ND | | | | |
| NS | spy1073 | gi-15675065 | cytoplasm | | | 50S ribosomal protein L7/L12 | ND | x | | | |
| NS | spy1260 | gi-15675219 | | | | hypothetical protein | ND | | | | |
| NS | spy1613 | gi-15675492 | | | | conserved protein - function unknown | ND | | | | |
| NS | spy1835 | gi-15675662 | | | | putative thioredoxin | ND | | | | |
| NS | spy2005 | gi-15675792 | | | | hypothetical protein | ND | | | | |
| NS | spy2093 | gi-15675850 | | | | putative elongation factor TS | ND | | | | |
| NS | spy2178 | gi-15675914 | | | | 30S ribosomal protein S4 | ND | | | | |
| 45 | NT01SP0246 | gi-1420859, gi-19745421, gi-28895133, gi-56808335 | | | | oligopeptide permease (lipoprotein) | | x | | | x |
| | spy0047 | gi-15674286 | | | | putative signal peptidase I (lepA) | | x | | | |
| NS | spy0127 | gi-5674342 | | | | | | x | | | |
| NS | spy0686 | gi-15674750 | | | | | | | | | x |

TABLE 8

GAS proteins identified after antibiotic treatment and overproduction of membrane vesicles

| GAS | spY | M1 = 1697 | PSORT prediction | TMD | Features | Description | FACS response (SF370) | Control | Penicillin | Vancomycin |
|---|---|---|---|---|---|---|---|---|---|---|
| 5 | spy0019 | gi-15674263 | outside | 0 | | putative secreted protein | positive | x | x | |
| 10 | spy0097 | gi-15674320 | membrane | 1 | | putative penicillin-binding protein 1b | positive | | x | |
| 23 | spy0163 | gi-15674368 | lipoprotein | 0 | lipoprotein | putative ABC transporter (lipoprotein) | negative | x | x | x |
| 24 | spy0165 | gi-15674370 | outside | 1 | | nicotine adenine dinucleotide glycohydrolase precursor | positive | x | x | |
| 49 | spy0317 | gi-15674482 | lipoprotein | 0 | lipoprotein | conserved hypothetical protein | negative | | x | |
| 56 | spy0385 | gi-15674531 | lipoprotein | 0 | lipoprotein | ferrichrome ABC transporter (ferrichrome-binding protein) | positive | | x | |
| 63 | spy0457 | gi-15674576 | lipoprotein | 0 | lipoprotein | putative cyclophilin-type protein | negative | | x | |
| 67 | spy0714 | gi-15674772 | outside | 0 | | putative adhesion protein | positive | | x | |

TABLE 8-continued

GAS proteins identified after antibiotic treatment and overproduction of membrane vesicles

| GAS | spY | M1 = 1697 | PSORT prediction | TMD | Features | Description | FACS response (SF370) | Control | Penicillin | Vancomycin |
|---|---|---|---|---|---|---|---|---|---|---|
| 72 | spy0903 | gi-15674925 | membrane | 1 | | putative ABC transporter (binding protein) | positive | x | x | |
| 78 | spy1094 | gi-15675078 | lipoprotein | 0 | lipoprotein | conserved hypothetical protein | negative | | x | |
| 81 | spy1228 | gi-15675192 | lipoprotein | 0 | lipoprotein | putative lipoprotein | positive | x | x | x |
| 83 | spy1273 | gi-15675228 | outside | 0 | | CAMP factor | positive | | x | |
| 84 | spy1274 | gi-15675229 | lipoprotein | 0 | lipoprotein | putative amino acid ABC transporter, periplasmic amino acid-binding protein | positive | x | x | |
| 86 | spy1294 | gi-15675247 | lipoprotein | 0 | lipoprotein | putative maltose/maltodextrin-binding protein | negative | | x | |
| 89 | spy1390 | gi-15675314 | lipoprotein | 0 | lipoprotein | putative protease maturation protein | positive | | x | |
| 98 | spy1882 | gi-15675700 | lipoprotein | 0 | lipoprotein | putative acid phosphatase | positive | x | x | |
| 100 | spy2000 | gi-15675787 | lipoprotein | 0 | lipoprotein | surface lipoprotein | negative | | x | x |
| 103 | spy2037 | gi-15675810 | lipoprotein | 0 | lipoprotein | conserved hypothetical | positive | | x | |
| 157 | spy0836 | gi-15674871 | membrane | 1 | | conserved hypothetical protein | positive | | x | |
| 160 | spy1113 | gi-15675094 | membrane | 1 | RGD | putative acid phosphatase (class B) | positive | | x | |
| 177 | spy1649 | gi-15675521 | membrane | 1 | | putative penicillin-binding protein 1a | positive | | x | |
| 192 | spy2018 | gi-15675799 | membrane | 2 | LPXTG | M protein type 1 | positive | x | | |
| 194 | spy2032 | gi-15675807 | membrane | 1 | | putative ATP-binding cassette transporter-like protein | positive | | x | |
| 201 | spy2216 | gi-15675945 | membrane | 1 | | putative serine protease | positive | | x | |
| 205 | spy0453 | gi-15674573 | lipoprotein | 0 | lipoprotein | metal binding protein of ABC transporter | negative | x | x | |
| 284 | spy2059 | gi-15675827 | membrane | 1 | | penicillin-binding protein 2a | ND | | x | |
| 286 | spy2065 | gi-15675830 | membrane | 1 | | hypothetical protein | negative | | x | |
| 292 | spy2073 | gi-15675834 | membrane | 1 | RGD | putative endopeptidase Clp ATP-binding chain C | negative | x | | |
| 382 | spy1842 | gi-15675668 | outside | 1 | | putative signal peptidase | positive | | x | |
| 396 | spy2116 | gi-15675866 | membrane | 1 | | recombination protein | negative | x | | |
| 405 | spy1028 | gi-15675026 | membrane | 1 | | putative acetoin dehydrogenase (TPP-dependent) beta chain | positive | | | x |
| 406 | spy1031 | gi-15675028 | membrane | 1 | | putative dihydrolipoamide dehydrogenase, component E3 | positive | x | | |
| 500 | spy1410 | gi-15675330 | membrane | 2 | | putative 1-acylglycerol-3-phosphate O-acyltransferase | ND | x | | |
| | spy0047 | gi-15674286 | cytoplasm | | | 30S ribosomal protein S10 | ND | | x | |
| | spy0053 | gi-15674291 | cytoplasm | | | 30S ribosomal protein S19 | ND | | x | |
| | spy0056 | gi-15674293 | cytoplasm | | | 30S ribosomal protein S3 | ND | x | | |
| | spy0063 | gi-15674299 | cytoplasm | | | 50S ribosomal protein L5 | ND | x | x | |
| | spy0069 | gi-15674304 | cytoplasm | | | 30S ribosomal protein S5 | ND | | x | |
| | spy0098 | gi-15674321 | cytoplasm | | | putative DNA-dependent RNA polymerase subunit beta | ND | x | | |
| | spy0127 | gi-15674342 | cytoplasm | | | putative signal peptidase I | ND | | x | |
| | spy0274 | gi-15674453 | cytoplasm | | | glyceraldehyde-3-phosphate dehydrogenase, plasmin receptor | ND | | x | |
| | spy0611 | gi-15674691 | cytoplasm | | | putative translation elongation factor EF-Tu | ND | | x | |
| | spy0666 | gi-15674733 | cytoplasm | | | hyothetical protein, phage associated | ND | x | | |
| | spy0686 | gi-15674750 | cytoplasm | | | hypothetical protein, phage associated | ND | | x | |
| | spy0688 | gi-15674751 | cytoplasm | | | putative major head protein, phage associated | ND | | x | |
| | spy0731 | gi-15674785 | cytoplasm | | | putative enolase | ND | x | x | |
| | spy0913 | gi-15674934 | cytoplasm | | | putative ribosomal protein S1-like DNA-binding protein | ND | x | | |
| | spy1200 | gi-15675165 | membrane | | | putative signal recognition particle | ND | x | | |
| | spy1281 | gi-15675234 | membrane | | | putative signal peptidase I | ND | | x | |
| | spy1721 | gi-15675571 | cytoplasm | | | putative initiation factor 2 | ND | | x | |
| | spy1750 | gi-15675599 | cytoplasm | | | putative malonyl CoA-acyl carrier protein transacylase | ND | | x | |
| | spy1805 | gi-15675639 | cytoplasm | | | putative preprotein translocase binding subunit | ND | | x | |
| | spy2070 | gi-15675832 | cytoplasm | | | heat shock protein (chaperonin) | ND | x | | |
| | spy2092 | gi-15675849 | cytoplasm | | | 30S ribosomal protein S2 | ND | x | x | |
| | spy2178 | gi-15675914 | cytoplasm | | | 30S ribosomal protein S4 | ND | | x | |
| | | gi-21909751 | lipoprotein | | | oligopeptide permease [Streptococcus pyogenes MGAS315] | ND | | x | |

TABLE 9

|  | Protein | GAS | Spy | Gene locus (a) | Tryptic peptides (b) | Proteinase K peptides (b) | FACS response (c) |
|---|---|---|---|---|---|---|---|
| Cell-wall proteins | collagen binding protein |  |  | NT01SP0102 | — | 2 | Positive |
|  | hypothetical protein | 16 | 0128 | NT01SP0105 | — | 1 | Positive |
|  | putative cell envelope proteinase | 57 | 0416 | NT01SP0336 | 2 | 3 | Positive |
|  | putative extracellular matrix binding protein | 68 | 0737 | NT01SP0588 | 1 | — | Positive |
|  | conserved hypothetical protein | 143 | 0747 | NT01SP0597 | 4 | 2 | Positive |
|  | hypothetical protein | 158 | 0843 | NT01SP0677 | 1 | — | Positive |
|  | protein GRAB (protein G-related alpha 2M-binding protein) | 166 | 1357 | NT01SP1118 | 2 | — | Positive |
|  | hypothetical protein | 171 | 1494 | NT01SP1232 | — | 1 | ND |
|  | collagen-like surface protein | 188 | 1983 | NT01SP1628 | 3 | 2 | Positive |
|  | hypothetical protein | 190 | 2009 | NT01SP1652 | 11 | 35 | Positive |
|  | C5A peptidase precursor | 191 | 2010 | NT01SP1653 | 7 | 16 | Positive |
|  | M protein type 1 | 192 | 2018 | NT01SP1656 | 26 | 12 | Positive |
| Lipoproteins | putative ABC transporter | 23 | 0163 | NT01SP0136 | 2 | — | Negative |
|  | oligopeptide permease | NS |  | NT01SP0246 | 4 | — | Negative |
|  | conserved hypothetical protein | 49 | 0317 | NT01SP0264 | — | 1 | Positive |
|  | hypothetical protein | 685 | 0319 | NT01SP0265 | 2 | — | Positive |
|  | putative cyclophilin-type protein | 63 | 0457 | NT01SP0363 | 1 | — | Positive |
|  | hypothetical protein | 108 | 0604 | NT01SP0479 | 1 | — | Positive |
|  | putative amino acid ABC transporter, periplasmic amino acid-binding protein | 84 | 1274 | NT01SP1051 | 3 | 1 | Positive |
|  | putative maltose/maltodextrin-binding protein | 86 | 1294 | NT01SP1068 | 5 | — | Positive |
|  | putative protease maturation protein | 89 | 1390 | NT01SP1145 | 2 | 1 | Positive |
|  | putative acid phosphatase | 98 | 1882 | NT01SP1546 | 5 | 3 | Positive |
|  | hypothetical protein | 103 | 2037 | NT01SP1670 | 1 | — | Positive |
| Membrane proteins | putative cell division protein (1) (d) | 254 | 0015 | NT01SP0014 | 2 | — | Negative |
|  | putative large conductance mechanosensitive channel (1) | 286 | 0780 | NT01SP0624 | 2 | — | Positive |
|  | hypothetical protein (1) | 287 | 0802 | NT01SP0643 | — | 1 | Negative |
|  | conserved hypothetical protein (1) | 288 | 0836 | NT01SP0670 | 11 | 1 | Positive |
|  | putative ABC transporter (binding protein) (1) | 271 | 0903 | NT01SP0728 | 3 | — | Positive |
|  | putative acetoin dehydrogenase (TPP-dependent) beta (1) | 320 | 1028 | NT01SP0833 | 4 | 1 | Positive |
|  | putative dihydrolipoamide dehydrogenase, component E3 (1) | 321 | 1031 | NT01SP0836 | 1 | — | Positive |
|  | putative citrate lyase, beta subunit (1) | 317 | 1188 | NT01SP0978 | 1 | — | ND |
|  | putative deacetylase (1) | 293 | 1370 | NT01SP1129 | 1 | — | ND |
|  | putative cell division protein (1) | 307 | 1520 | NT01SP1255 | 2 | 2 | Positive |
|  | putative beta-galactosidase (1) | 308 | 1586 | NT01SP1309 | 1 | — | ND |
|  | hypothetical protein (1) | 309 | 1643 | NT01SP1353 | 1 | — | ND |
|  | putative penicillin-binding protein 1a (1) | 295 | 1649 | NT01SP1358 | 2 | — | Positive |
|  | hypothetical protein (1) | 310 | 1686 | NT01SP1386 | 3 | — | ND |
|  | hypothetical protein sharing similarity with several eukaryotic proteins (1) | 311 | 1798 | NT01SP1481 | 2 | — | Positive |
|  | hypothetical protein (1) | 312 | 1939 | NT01SP1594 | 1 | — | Positive |
|  | immunogenic secreted protein precursor (1) | 300 | 2025 | NT01SP1661 | 1 | — | Negative |
|  | putative ATP-binding cassette transporter-like protein (1) | 301 | 2032 | NT01SP1666 | 1 | — | Positive |
|  | hypothetical protein (1) | 313 | 2033 | NT01SP1667 | 3 | 1 | Positive |
|  | mitogenic factor (1) | 302 | 2043 | NT01SP1676 | 1 | — | Negative |
|  | putative serine protease (1) | 304 | 2216 | NT01SP1817 | 5 | 1 | Positive |
|  | putative surface exclusion protein (2) | 262 | 0269 | NT01SP0226 | 1 | — | Positive |

TABLE 9-continued

|  | Protein | GAS | Spy | Gene locus (a) | Tryptic peptides (b) | Proteinase K peptides (b) | FACS response (c) |
|---|---|---|---|---|---|---|---|
|  | hypothetical protein (2) | 306 | 1044 | NT01SP0849 | — | 1 | ND |
|  | hypothetical protein (2) | 291 | 1154 | NT01SP0947 | 3 | 1 | Positive |
|  | putative 1-acylglycerol-3-phosphate O-acyltransferase (2) | 327 | 1410 | NT01SP1162 | 1 | — | ND |
|  | conserved hypothetical protein (2) | 303 | 2184 | NT01SP1789 | 1 | — | Negative |
|  | putative glutamine-binding periplasmic protein (3) | 323 | 0277 | NT01SP0233 | 1 | — | Positive |
|  | hypothetical protein (3) | 264 | 0351 | NT01SP0289 | 1 | — | ND |
|  | putative mannose-specific phosphotransferase system component IID (3) | 328 | 1740 | NT01SP1433 | 1 | — | ND |
|  | putative cell-division protein (4) | 325 | 0645 | NT01SP0510 | 1 | — | ND |
|  | hypothetical protein (4) | 330 | 1315 | NT01SP1085 | 4 | — | Positive |
|  | putative ABC transporter (ATP-binding protein) (4) | 331 | 2029 | NT01SP1664 | — | 1 | ND |
|  | putative glycine-betaine binding permease protein (6) | 322 | 0184 | NT01SP0154 | 2 | — | Positive |
|  | hypothetical protein (6) | 326 | 0743 | NT01SP0593 | — | 1 | ND |
|  | beta-glucoside permease IIABC component (7) | 324 | 0572 | NT01SP0454 | — | 2 | ND |
|  | putative L-malate permease (10) | 329 | 1109 | NT01SP0906 | — | 1 | ND |
|  | putative integral membrane protein (11) | 332 | 2120 | NT01SP1737 | 1 | — | ND |
| Secreted proteins | putative secreted protein | 255 | 0019 | NT01SP0016 | 2 | — | Positive |
|  | nicotine adenine dinucleotide glycohydrolase precursor | 260 | 0165 | NT01SP0138 | 4 | 2 | Positive |
|  | streptolysin O precursor | 261 | 0167 | NT01SP0140 | 2 | — | Negative |
|  | putative 42 kDa protein | 268 | 0469 | NT01SP0372 | 4 | 4 | Positive |
|  | putative cyclomaltodextrin glucanotransferase | 277 | 1302 | NT01SP1075 | 1 | — | ND |
|  | hypothetical protein | 334 | 1461 | NT01SP1204 | 1 | — | Positive |
|  | putative signal peptidase I | 318 | 1842 | NT01SP1514 | 1 | — | Positive |
|  | inhibitor of complement-mediated lysis | 281 | 2016 | NT01SP1655 | 1 | — | Positive |
| Cytoplasmic proteins | putative translation elongation factor EF-Tu | 346 | 0611 | NT01SP0485 | 5 | 5 | ND |
|  | 50S ribosomal protein L31 | 350 | 0717 | NT01SP0572 | 3 | — | ND |
|  | conserved hypothetical protein - possibly involved in cell wall localization and side chain formation | 352 | 0792 | NT01SP0634 | — | 1 | ND |
|  | 50S ribosomal protein L7/L12 | 355 | 1073 | NT01SP0877 | 3 | — | ND |

(a) Gene locus names according to TIGR database (www host server, domain name tigr.org).
(b) Number of peptides identified from trypsin or proteinase K digestions.
(c) A response was considered as positive when the difference between the value of immune serum and that of preimmune serum was higher than 80; otherwise, it was considered as negative.
(d) Number of transmembrane domains predicted by PSORT (in brackets)

TABLE 10

Hyaluronic acid content of GAS bacteria capsules (fg/CFU)

|  | M1 | M3 | M6 | M23 |
|---|---|---|---|---|
| 1 | 23.31 | 49 | 22.76 | 26.8 |
| 2 | 14.22 | 57.51 | 22.29 | 19.75 |
| 3 | 14.38 | 47.63 | 22.01 | 21.28 |
| AVERAGE | 17.3 | 51.38 | 22.35 | 22.61 |
| SD | 5.2 | 5.35 | 0.38 | 3.71 |

TABLE 11

| Protein | Gene locus (a) | FACS response (b) | Homology to SF370 gene locus | Found in SF370? |
|---|---|---|---|---|
| M protein type 3 | NT06SP1825 | positive | NT01SP1656 (GAS192) | yes |
| C5A peptidase precursor | NT06SP1824 | ND | NT01SP1653 (GAS191) | yes yes |
| GRAB precursor | NT06SP0874 | positive | NT01SP1118 (GAS166) | yes yes |
| protein F2-like protein | NT06SP0112 | positive | — | — |
| hypothetical protein SPs1285 | NT06SP1358 | negative | NT01SP0677 (GAS158) | yes |
| putative penicillin binding protein 2X | NT06SP0490 | ND | SPY1664 (spy1664) | no |
| putative large conductance mechanosensitive channel | NT06SP1414 | ND | NT01SP0624 (GAS149) | yes |
| putative 42 kDa protein | NT06SP1611 | ND | NT01SP0372 (GAS64) | yes |
| hypothetical protein SPs1270 | NT06SP1343 | ND | SPY0861 (spy0861) | no |
| putative translation elongation factor EF-Tu | NT06SP1502 | ND | NT01SP0485 (GAS193) | yes |

(a) Gene locus names according to TIGR database (www host server, domain name tigr.org).
(b) A response was considered as positive when the difference between the value of immune serum and that of preimmune serum was higher than 80; otherwise, it was considered as negative.

TABLE 12

| Protein (ref no.) | Immunization route (a) | Challenge (a) | Readout | gene present in SF370 | identified (Y/N) |
|---|---|---|---|---|---|
| Cell-wall proteins | | | | | |
| M protein (n) | IN | IP | survival | YES | YES |
| C5a peptidase (n + 1) | IN | IN | colonization | YES | YES |
| hypothetical protein (n + 2) | SC | IP | survival | YES | YES |
| protein GRAB (protein G-related alpha 2M-binding protein) (n + 3) | SC | IP | bactericidal assay | YES | YES |
| SPA (streptococcal protective antigen) (n + 4) | IP | IP | survival | NO | — |
| Sfb I (n + 5) | IN | IN | survival | NO | — |
| FBP54 (n + 6) | IN | IP | survival | NO | — |
| R28 (n + 7) | IP | IP | survival | NO | — |
| Lipoproteins | | | | | |
| ferrichrome ABC transporter (ferrichrome-binding protein) (n + 8) | SC | | bactericidal assay | YES | NO |
| putative phosphate ABC transporter (n + 8) | SC | | bactericidal assay | YES | NO |
| putative amino acid ABC transporter, periplasmic amino acid-binding protein (n + 8) | SC | | bactericidal assay | YES | YES |
| putative protease maturation protein (n + 8) | SC | | bactericidal assay | YES | YES |

TABLE 12-continued

| Protein (ref no.) | Immunization route (a) | Challenge (a) | Readout | gene present in SF370 | identified (Y/N) |
|---|---|---|---|---|---|
| hypothetical protein (n + 8) | SC | | bactericidal assay | YES | NO |
| Secreted proteins | | | | | |
| SpeA (n + 9) | SC | SC | survival | NO | — |
| SpeB (n + 10) | SC | SC | survival | YES | NO |

(a). IN: intranasal; SC: subcutaneous; IP: intraperitoneal.

(n) Hu, M. C. et al. Infect Immun 70, 2171-2177 (2002).

(n + 1) Ji, Y., Carlson, B., Kondagunta, A. & Cleary, P. P. Infect Immun 65, 2080-2087 (1997).

(n + 2) Reid, S. D. et al. J Bacteriol 184, 6316-6324 (2002).

(n + 3) McMillan, D. J. et al. Vaccine 22, 2783-2790 (2004).

(n + 4) J. B. Dale et al., J. Clin. Investig. 103: 1261-1268, 1999

(n + 5) Roggiani et al. Infect Immun. 2000 Sep; 68(9): 5011-7. Toxoids of streptococcal pyrogenic exotoxin A are protective in rabbit models of streptococcal toxic shock syndrome.

(n + 6) Kuo et al. Infect Immun. 1998 Aug; 66(8): 3931-5.

(n + 7) Schulze et al. Infect Immun. 2001 Jan; 69(1): 622-5. Characterization of the domain of fibronectin-binding protein I of *Streptococcus pyogenes* responsible for elicitation of a protective immune response.

(n + 8) Lei et al. J Infect Dis 189, 79-89 (2004).

(n + 9) Kawabata et al. Infect Immun. 2001 Feb; 69(2): 924-30.

(n + 10) Stalhammar-Carlemalm et al. Mol Microbiol. 1999 Jul; 33(1): 208-19.

TABLE 13

| Protein | Gene locus (a) | FACS response (b) | Homology to SF370 gene locus | Found in SF370? |
|---|---|---|---|---|
| Cell-wall proteins | | | | |
| M23 protein | NT03SP1933 | positive | NT01SP1656 | yes |
| putative cell envelope proteinase | NT01SP0336 | positive | NT01SP0336 | yes |
| hypothetical protein | NT01SP0677 | negative | NT01SP0677 | yes |
| C5A peptidase precursor | NT01SP1653 | positive | NT01SP1653 | yes |
| GRAB precursor | NT01SP1118 | positive | NT01SP1118 | yes |
| Lipoproteins | | | | |
| putative amino acid ABC transporter, periplasmic amino acid-binding protein | NT01SP1051 | positive | NT01SP1051 | yes |
| putative oligopeptidepermease | NT06SP0237 | negative | NT01SP0246 | yes |
| putative acid phosphatase | NT01SP1546 | negative | NT01SP1546 | yes |
| hypothetical protein SpyM3_0427 | NT04SP0510 | negative | NT01SP0479 | yes |
| Membrane proteins | | | | |
| putative ABC transporter (binding protein) | NT01SP0728 | negative | NT01SP0728 | yes |
| putative zinc-containing alcohol dehydrogenase | NT01SP0908 | ND | NT01SP0908 | no |
| hypothetical protein | NT01SP0643 | ND | NT01SP0643 | yes |
| hypothetical protein sharing similarity with several eukaryotic proteins | NT01SP1481 | ND | NT01SP1481 | yes |
| conserved hypothetical protein | NT01SP0670 | ND | NT01SP0670 | yes |
| Secreted proteins | | | | |
| putative 42 kDa protein | NT01SP0372 | positive | NT01SP0372 | yes |
| putative regulatory protein - RofA related | NT01SP0182 | ND | NT01SP0182 | no |
| Cytoplasmic proteins | | | | |
| elongation factor Tu | NT01SP0485 | ND | NT01SP0485 | yes |

(a) Gene locus names according to TIGR database (www host server, domain name tigr.org).
(b) A response was considered as positive when the difference between the value of immune serum and that of preimmune serum was higher than 80; otherwise, it was considered as negative.

TABLE 14

| Antigen (a) | Mice tested | Survival (%) | Statistical significance (b) |
|---|---|---|---|
| GSTstop | 10 | 0 | — |
| M23 protein (M protein) | 8 | 88 | $p < 0.01$ |
| Putative cell envelope proteinase (GAS57) | 10 | 70 | $p < 0.01$ |

(a) GSTstop was considered as negative control; the M23 protein was used as positive control.
(b) Statistical significance was calculated by applying the Student t-test.

TABLE 15

| DOMAIN | 2071 (M23) | | | 3348 (M1) | | | 2728 (M12) | | |
|---|---|---|---|---|---|---|---|---|---|
| | pre-immune serum | immune serum | delta mean | pre-immune serum | immune serum | delta mean | pre-immune serum | immune serum | delta mean |
| 35d | 95.28 | 105.71 | 10 | 172.33 | 255.69 | 83 | 266.79 | 553.32 | 287 |
| 414d | 108.44 | 175.64 | 67 | 201.8 | 414.32 | 213 | 268.91 | 388.43 | 120 |
| 426d | 92.42 | 136.77 | 44 | 145.4 | 264.04 | 119 | 300.53 | 341.25 | 41 |
| 433d | 91.9 | 111.47 | 20 | 168.14 | 265.3 | 97 | 335.2 | 356.71 | 22 |
| 434d | 91.21 | 93.68 | 2 | 139.75 | 351.4 | 212 | 241.07 | 269.88 | 29 |
| 437d | 105.42 | 109.07 | 4 | 218.16 | 362.96 | 145 | 279.21 | 471.98 | 193 |
| 438d | 95.5 | 130.53 | 35 | 166.24 | 344.14 | 178 | 245.95 | 398.61 | 153 |
| 439d | 96.68 | 112.59 | 16 | 178.59 | 300.51 | 122 | 226.79 | 277.53 | 51 |
| 461d | 96.19 | 88.41 | −8 | 176.06 | 300.86 | 125 | 211.53 | 450.74 | 239 |
| 465d2 | 100.53 | 180.78 | 80 | 159.66 | 549.67 | 390 | 188.8 | 349.13 | 160 |
| 469d | 95.98 | 168.75 | 73 | 147.66 | 298.88 | 151 | 213.19 | 377.33 | 164 |
| 472d | 94.03 | 614.09 | 520 | 185.72 | 314.17 | 128 | 271.64 | 378.72 | 107 |
| 473d | 99.02 | 181.42 | 82 | 196.62 | 301.73 | 105 | 195.86 | 431.12 | 235 |
| 475d | 89.2 | 122.68 | 33 | 149.38 | 585.46 | 436 | 190.67 | 362.94 | 172 |
| 477d | 96.6 | 462.96 | 366 | 168.87 | 174.78 | 6 | 255.38 | 301 | 46 |
| 478d | 94.39 | 154.52 | 60 | 212.82 | 312.16 | 99 | 232.82 | 364.84 | 132 |
| 495d | 101.2 | 247.12 | 146 | 189.23 | 293.31 | 104 | 300 | 281.18 | −19 |
| 538d | 87.54 | 115.05 | 28 | 138.98 | 398.82 | 260 | 195.32 | 375.33 | 180 |
| 543d | 91.8 | 157.39 | 66 | 156.31 | 313.49 | 157 | 287.79 | 335.98 | 48 |
| 553d | 97.15 | 615.01 | 518 | 150.74 | 407.06 | 256 | 204.53 | 394.8 | 190 |
| 561d | 94.97 | 104.19 | 9 | 153.23 | 354.63 | 201 | 183.4 | 424.87 | 241 |
| 576d | 90.59 | 112.74 | 22 | 130.54 | 205.59 | 75 | 222.05 | 221.83 | 0 |
| 577d2 | 90.31 | 127.93 | 38 | 160.78 | 269.23 | 108 | 257.02 | 382.01 | 125 |
| 587d | 90.54 | 110.13 | 20 | 137.16 | 210.82 | 74 | 167.69 | 346.71 | 179 |
| 591d | 92.11 | 106.37 | 14 | 155.59 | 295.09 | 140 | 206.83 | 384.75 | 178 |
| 592d | 95.43 | 100.91 | 5 | 152.51 | 422.63 | 270 | 219.72 | 609.94 | 390 |
| 636d | 90.55 | 147.85 | 57 | 139.37 | 354.74 | 215 | 176.56 | 283.64 | 107 |
| 643d | 88.76 | 113.79 | 25 | 161.75 | 471.95 | 310 | 227.82 | 393.73 | 166 |
| 649d | 90.54 | 106.66 | 16 | 147.24 | 418.67 | 271 | 169.2 | 323.19 | 154 |
| 663d | 90.74 | 131.27 | 41 | 184.68 | 323.92 | 139 | 254.16 | 388.85 | 135 |

TABLE 16

Preferred GAS antigens.

| ID_Prot | ID_ORF | Annotation | Gene name | Protein length | Evidence for surface exposure |
|---|---|---|---|---|---|
| GAS5 | gi-13621340 | putative secreted protein | spy0019 | 398 | FACS and association to vesicles |
| GAS6 | gi-13621352 | putative choline binding protein | spy0031 | 374 | FACS |
| GAS15 | gi-23503478 | | NT01SP0102 | 762 | Surface digestion |
| GAS16p2 | gi-13621428 | hypothetical protein (fimbrial) | SPy0128 | 340 | Surface digestion |
| GAS18 | gi-13621430 | hypothetical protein | spy0130 | 215 | FACS |
| GAS22 | gi-13621454 | hypothetical protein | spy0159 | 292 | FACS |
| GAS23 | gi-13621456 | putative ABC transporter (lipoprotein) | spy0163 | 342 | FACS and association to membrane vesicles |
| GAS25 | gi-13621460 | streptolysin O precursor | spy0167 | 571 | FACS and surface digestion |
| GAS29 | gi-13621499 | hypothetical protein | spy0210 | 410 | FACS |
| GAS30 | gi-13621500 | exotoxin G precursor | spy0212 | 234 | FACS |
| GAS36 | gi-13622477 | putative sugar transporter sugar binding lipoprotei | spy1368 | 439 | FACS |
| GAS40a-RR | gi-13621545 | putative surface exclusion protein | spy0269 | 873 | Protection (see WO 05/032582) and surface digestion |
| GAS42 | gi-13621559 | conserved hypothetical protein | spy0287 | 420 | Protection (see WO 05/032582) |
| GAS45 | gi: 19745421 | oligopeptide permease presente in M3-M18 | NT01SP0246 | 659 | Surface digestion (see also WO 05/032582) |

TABLE 16-continued

Preferred GAS antigens.

| ID_Prot | ID_ORF | Annotation | Gene name | Protein length | Evidence for surface exposure |
|---|---|---|---|---|---|
| GAS49 | gi-13621582 | conserved hypothetical protein | spy0317 | 280 | FACS and association to membrane vesicles |
| GAS56 | gi-13621635 | ferrichrome ABC transporter (ferrichrome-binding prot) | spy0385 | 310 | Surface digestion and surface exposed domain |
| GAS57 | gi-13621655 | putative cell envelope proteinase | spy0416 | 1647 | Surface digestion (see also WO 05/032582) |
| GAS60 | gi-13621668 | putative exotoxin (superantigen) | spy0436 | 232 | FACS |
| GAS62 | gi-13622790 | conserved hypothetical protein | spy1736 | 319 | FACS |
| GAS63 | gi-13621684 | putative cyclophilin-type protein | spy0457 | 268 | FACS and association with membrane vesicles |
| GAS65 | gi-13621895 | pyrogenic exotoxin C precursor, phage associated | spy0711 | 235 | FACS |
| GAS67 | gi-13621898 | putative adhesion protein | spy0714 | 515 | FACS, surface digestion and association with vesicles |
| GAS68 | gi-13621916 | putative extracellular matrix binding protein | spy0737 | 2045 | FACS and surface digestion |
| GAS69 | gi-13621955 | putative ABC transporter (substrate-binding protein | spy0778 | 270 | FACS |
| GAS75 | gi-13622180 | extracellular hyaluronate lyase | spy1032 | 805 | FACS |
| GAS76 | gi-13622185 | conserved hypothetical protein | spy1037 | 318 | FACS |
| GAS77 | gi-13622199 | putative collagen-like protein | spy1054 | 293 | FACS |
| GAS81 | gi-13622358 | putative lipoprotein | spy1228 | 350 | FACS, surface digestion and association to membrane vesicles |
| GAS82 | gi-13622372 | putative phosphate ABC transporter, periplasmic pho | spy1245 | 288 | FACS |
| GAS84 | gi-13622398 | putative amino acid ABC transporter, periplasmic am | spy1274 | 278 | Association to membrane vesicles (see also WO 05/032582) |
| GAS85 | gi-13622414 | hypothetical protein | spy1290 | 206 | FACS |
| GAS86 | gi-13622418 | putative maltose/maltodextrin-binding protein | spy1294 | 415 | FACS and association to membrane vesicles |
| GAS88 | gi-13622470 | putative internalin A precursor | spy1361 | 792 | FACS |
| GAS89 | gi-13622493 | putative protease maturation protein | spy1390 | 351 | FACS and association to membrane vesicles |
| GAS91 | gi-13622581 | conserved hypothetical protein | spy1491 | 195 | FACS |
| GAS92 | gi-13622642 | hypothetical protein | spy1558 | 207 | FACS |
| GAS94 | gi-13622705 | conserved hypothetical protein | spy1633 | 535 | FACS |
| GAS95 | gi-13622787 | putative transcription regulator | spy1733 | 424 | FACS (see also WO 05/032582) |
| GAS96 | gi-13622842 | putative ABC transporter (periplasmic binding prot) | spy1795 | 294 | FACS |
| GAS97 | gi-13622846 | immunogenic secreted protein precursor homolog | spy1801 | 503 | FACS |
| GAS98 | gi-13622916 | putative acid phosphatase | spy1882 | 284 | FACS and association to membrane vesicles |
| M30098 | gi-21909634 | putative collagen binding protein (Cpb) | SpyM3_0098 | 744 | See U.S. Pat. No. 6,777,547-B1 |
| GAS99 | gi-13622993 | streptokinase A precursor | spy1979 | 440 | FACS |
| GAS100 | gi-13623012 | surface lipoprotein | spy2000 | 542 | FACS, surface digestion and association to membrane vesicles |
| M3_0100 | gi-21909636 | conserved hypothetical protein (fimbrial) | SpyM3_0100 | 344 | |
| GAS101 | gi-13623020 | putative laminin adhesion | spy2007 | 306 | FACS |
| M3_0102 | gi-21909638 | hypothetical protein | SpyM3_0102 | 195 | |
| GAS103 | gi-13623038 | conserved hypothetical | spy2037 | 309 | FACS and association to membrane vesicles |
| M3_0104 | gi-21909640 | protein F2 like fibronectin-binding protein | SpyM3_0104 | 696 | See U.S. Pat. No. 6,355,477-B1 |
| GAS105 | gi-13623061 | putative dipeptidase | spy2066 | 498 | FACS |
| SPs0106 | gi-28895018 | protein F2 like fibronectin-binding protein | SPs0106 | 733 | See U.S. Pat. No. 6,355,477-B1 |
| GAS108 | gi-13621804 | hypothetical protein | spy0604 | 128 | FACS and surface digestion |
| GAS117-40 + A97 | gi-15674571 | hypothetical protein | spy0448 | 113 | See WO 05/032582 |
| GAS130 | gi-13621804 | putative protease | spy0604 | 428 | See WO 05/032582 |
| GAS137 | gi-13621804 | conserved hypothetical protein | spy0604 | 296 | See WO 05/032582 |
| GAS142 | gi-13621804 | streptolysin S associated ORF | spy0604 | 352 | FACS |
| GAS143 | gi-13621927 | conserved hypothetical protein | spy0747 | 910 | FACS and surface digestion |
| M6_0157 | gi-50913503 | Fibronectin-binding protein (protein F) | M6_Spy0157 | 628 | See WO 94/01465 |
| GAS158 | gi-13621804 | hypothetical protein | spy0604 | 1008 | FACS and surface digestion |
| M6_0159 | gi-50913505 | Collagen adhesion protein | M6_Spy0159 | 1037 | |
| GAS159a | gi-13621804 | putative spermidine/putrescine ABC transporter | spy0604 | 357 | See WO 05/032582 |

TABLE 16-continued

Preferred GAS antigens.

| ID_Prot | ID_ORF | Annotation | Gene name | Protein length | Evidence for surface exposure |
|---|---|---|---|---|---|
| M6_0160 | gi-50913506 | Fimbrial structural subunit | M6_Spy0160 | 557 | |
| GAS165 | gi-13622443 | conserved hypothetical protein | spy1326 | 364 | FACS |
| GAS166 | gi-13622466 | protein GRAB (protein G-related alpha 2M-binding pr | spy1357 | 217 | FACS and surface digestion |
| GAS175 | gi-13622660 | 3-dehydroquinate synthase | spy1577 | 357 | FACS |
| GAS178 | gi-13622756 | hypothetical protein | spy1697 | 240 | FACS |
| GAS179-1 | gi-13622773 | putative esterase | spy1718 | 328 | FACS |
| GAS187 | gi-13622989 | putative pullulanase | spy1972 | 1165 | FACS |
| GAS188 | gi-13622997 | collagen-like surface protei | spy1983 | 348 | FACS and surface digestion |
| GAS190 | gi-13623021 | Fba (Fibronectin binding protein) | spy2009 | 379 | FACS and surface digestion |
| GAS191 | gi-15675796 | C5a peptidase precursor | spy2010 | | Surface digestion |
| GAS193 | gi-13623029 | immunogenic secreted protein precursor | spy2025 | 541 | Surface digestion (see also WO 05/032582) |
| GAS195 | gi-13623043 | mitogenic factor | spy2043 | 271 | FACS and surface digestion |
| GAS205-1 | gi-13621681 | metal binding protein of ABC transporter (lipoprote | spy0453 | 310 | FACS and association to membrane vesicles |
| GAS206 | gi-13621912 | putative enolase | spy0731 | 435 | FACS and association to membrane vesicles |
| GAS208 | gi-13622029 | putative peptidoglycan hydrolase | spy0857 | 235 | FACS |
| GAS217 | gi-13622089 | putative oxidoreductase | spy0925 | 254 | See WO 05/032582 |
| GAS218 | gi-13622159 | putative lysin - phage associated | spy1006 | 444 | FACS |
| GAS218-t | gi-13622159 | putative lysin - phage associated | spy1006 | 444 | FACS |
| GAS219-1 | gi-13622160 | streptococcal exotoxin I | spy1007 | 225 | FACS |
| GAS220 | gi-15675016 | putative fibronectin binding protein like proteinA | spy1013 | | |
| GAS242 | gi-13622428 | maltose/maltodextrin-binding protein | spy1306 | 419 | FACS |
| GAS249 | gi-13622587 | putative hemolysin | spy1497 | 275 | FACS |
| GAS277a | gi-13622962 | hypothetical protein | spy1939 | 265 | Surface digestion (see also WO 05/032582) |
| GAS290 | gi-13622978 | conserved hypothetical protein | spy1959 | 180 | See WO 05/032582 |
| GAS294-1 | gi-13622306 | putative glucose-inhibited division protein | spy1173 | 448 | See WO 05/032582 |
| GAS327 | gi-13621729 | putative XAA-PRO dipeptidase; X-PRO dipeptidase | spy0513 | 361 | FACS |
| GAS380 | gi-13622855 | hypothetical protein | spy1813 | 995 | FACS |
| GAS384-RR | gi-13622908 | putative glycoprotein endopeptidase | spy1874 | 232 | See WO 05/032582 |
| GAS504 | gi-13622806 | putative trans-2-enoyl-ACP reductase II | spy1751 | 323 | See WO 05/032582 |
| GAS509 | gi-13622692 | putative O-acetylserine lyase | spy1618 | 313 | See WO 05/032582 |
| GAS511 | gi-13622798 | putative acetyl-CoA carboxylase alpha subunit | spy1743 | 256 | See WO 05/032582 |
| GAS527 | gi-13622332 | putative GMP synthase | spy1204 | 520 | See WO 05/032582 |
| GAS529 | gi-13622403 | putative L-glutamine-D-fructose-6-phosphate amidotr | spy1280 | 604 | See WO 05/032582 |
| GAS533 | gi-13622912 | putative glutamine synthetase | spy1877 | 448 | See WO 05/032582 |
| GAS680 | gi-13621481 | conserved hypothetical protein | spy0186 | 151 | numbered GAS58 in WO 05/032582 |
| 19224134 | gi-19224134 | protein F | | 698 | See WO 94/01465 |
| 19224135 | gi-19224135 | Cpa | | 756 | |
| 19224137 | gi-19224137 | EftLSL.A (fimbrial) | | 342 | |
| 19224141 | gi-19224141 | protein F2 | | 1161 | See U.S. Pat. No. 6,355,477-B1 |

SEQUENCE LISTING (998 sequences)

SEQ ID NO: 1 - protein, 659 aa, Streptococcus pyogenes
MKNNKNNGFVKNSFIYILMIIVVITGFQFYLKGTSTQSQQISYSKLIKHLKAGDIKSLSYQPSGSIIEVKGKYEKPQKVTVNSGLSFLGGRASTQVTEFSSLVLPSDTILKEMTAAADKNGTELTVKQESSSGTWITFLMSFLPIVIFAAFMMMMMNQGGGGARGAMSFGKNKAKSQSKGNVKVRFTDVAGAEEEKQELVEVVDFLKNPKKYKSLGARIPAGVLLEGPPGTGKTLLAKAVAGEAGVPFFSISGSDFVEMFVGVGASRVRSLFEDAKKAERAIIFIDEIDAVGRRRGAGMGGGNDEREQTLNQLLIEMDGFEGNENIIVIAATNRSDVLDPALLRPGRFDRKVLVGRPDVKGREAILRVHAKNKPLANDVNLKVVAQQTPGFVGADLENVLNEAALVAARRNKIKIDASDIDEAEDRVIAGPSKKDRTISQKEREMVAYHEAGHTIVGLVLSNARVVHKVTIVPRGRAGGYMIALPKEDQMLLSKEDLKEQLAGLMGGRVAEEIVFNAQTSGASNDFEQATQIARAMVTEYGMSEKLGPVQYEGNHAMMPGQISPEKAYSAQTAQMIDDEVRELLNQARNQAADIINENRDTHKLIAEALLKYETLDAAQIKSIYETGKMPVDLETDDNEAHALSYDEIKNKMTESESAE

SEQ ID NO: 2 - protein, 398 aa, Streptococcus pyogenes
MKKRILSAVLVSGVTLGAATTVGAEDLSTKIAKQDSIISNLTTEQKAAQNQVSALQAQVSSLQSEQDKLTARNTELEALSKRFEQEIKALTSQIVARNEKLKNQARSAYKNNETSGYINALLNSKSISDVVNRLVAINRAVSANAKLLEQQKADKVSLEEKQAANQTAINTIAANMAMAEENQNTLRTQQANLVAATANLALQLASATEDKANLVAQKEAAEKAAAEALAQEQAAKVKAQEQAAQQAASVEAAKSAITPAPQATPAAQSSNAIEPAALTAPAAPSAGPQTSYDSSNTYPVGQCTWGAKSLAPWAGNNWGNGGQWAYSAQAAGYRTGSTPMVGAIAVWNDGGYGHVAVVVEVQSASSIRVMESNYSGRQYIADHRGWFNPTGVTFIYPH

SEQ ID NO: 3 - protein, 374 aa, Streptococcus pyogenes
MKKFHRFLVSGVILLGFNGLVPTMPSTLISQQENLVHAAVLGDNYPSKWKKGNGIDSWNMYIRQCTSFAAFRLSSANGFQLPKGYGNACTWGHIAKNQGYPVNKTPSIGAIAWFDKNAYQSNAAYGHVAWVADIRGDTVTIEEYNYNAGQGPERYHKRQIPKSQVSGYIHFKDLSSQTSHSYPRQLKHISQASFDPSGTYHFTTRLPVKGQTSIDSPDLAYYEAGQSVYYDKVVTAGGYTWLSYLSFSGNRRYIPIKEPAQSVVQNDNTKPSIKVGDTVTFPGVFRVDQLVNNLIVNKELAGGDPTPLNWIDPTPLDETDNQGKVLGDQILRVGEYFIVTGSYKVLKIDQPSNGIYVQIGSRGTWVNADKANKL

SEQ ID NO: 4 - protein, 770 aa, Streptococcus pyogenes
MRYFMVKWNTKQKRISHQRLGLLDLGPVLLRTLRLLSNFFYIVIFLFGMMGFGMAFGYLASQIESVKVPSKESLVKQVESLTMISQMNYSDNSLISTLDTDLLRTPVANDAISENIKKAIVSTEDEHFQEHKGIVPKAVFRATLASVLGFGEASGGSTLTQQLVKQQVLGDDPTFKRKSKEIVYALALERYMSKDNILCDYLNVSPFGRNNKGQNIAGVEEAARGIFGVSAKDLTVPQAAFLAGLPQSPIVYSPYLSTGQLKSEKDMAYGIKRQQNVLFNMYRTGVLSKKEYEDYKAYPIQKDFIQPGSAIVNNHDYLYYTVLADAKKAMYSYLIKRDKVSSRDLKNDETKAAYEERALTELQQGGYTITTTINKPIYNAMQTAAAQFGGLLDDGTGTVQMGNVLTDNATGAVLGFVGGRDYALNQNNHAFNTVRSPGSSIKPIIAYGPAIDQGLMGSASVLSNYPTTYSSGQKIMHADSEGTAMMPLQEALNTSWNIPAFWTQKLLREKGVDVENYMTKMGYKIADYSIESLPLGGGIEVSVAQQTNAYQMLSNNGLYQKQYIVDKITASDGTVVYKHENKPIRIFSAATATILQELLRGPITSGATTTFKNRLAAINPWLANADWIGKTGTTENYTDVWLVLSTPKVTLGGWAGHDDNTSLAPLTGYNNNSNYLAYLANAINQADPNVIGVGQRFNLDPGVIKANVLKSTGLQPGTVNVNGHTFSVGGEMTTSLWSQKGPGAMTYRFAIGGTDADYQKAWGNFGFRKN

SEQ ID NO: 5 - protein, 757 aa, Streptococcus pyogenes
MKKTRFPNKLNTLNTQRVLSKNSKRFTVTLVGVFLMIFALVTSMVGAKTVFGLVESSTPNAINPDSSSEYRWYGYESYVRGHPYYKQFRVAHDLRVNLEGSRSYQVYCFNLKKAFPLGSDSSVKKWYKKHDGISTKFEDYAMSPRITGDELNQKLRAVMYNGHPQNANGIMEGLEPLNAIRVTQEAVWYYSDNAPISNPDESFKRESESNLVSTSQLSLMRQALKQLIDPNLATKMPKQVPDDFQLSIFESEDKGDKYNKGYQNLLSGGLVPTKPPTPGDPPMPPNQPQTTSVLIRKYAIGDYSKLLEGATLQLTGDNVNSFQARVFSSNDIGERIELSDGTYTLTELNSPAGYSIAEPITFKVEAGKVYTIIDGKQIENPNKEIVEPYSVEAYNDFEEFSVLTTQNYAKFYYAKNKNGSSQVVYCFNADLKSPPDSEDGGKTMTPDFTTGEVKYTHIAGRDLFKYTVKPRDTDPDTFLKHIKKVIEKGYREKGQAIEYSGLTETQLRAATQLAIYYFTDSAELDKDKLKDYHGFGDMNDSTLAVAKILVEYAQDSNPPQLTDLDFFIPNNNKYQSLIGTQWHPEDLVDIIRMEDKKEVIPVTHNLTLRKTVTGLAGDRTKDFHFEIELKNNKQELLSQTVKTDKTNLEFKDGKATINLKHGESLTLQGLPEGYSYLVKETDSEGYKVKVNSQEVANATVSKTGITSDETLAFENNKEPVVPTGVDQKINGYLALIVIAGISLGIWGIHTIRIRKHD

SEQ ID NO: 6 - protein, 340 aa, Streptococcus pyogenes
MKLRHLLLTGAALTSFAATTVHGETVVNGAKLTVTKNLDLVNSNALIPNTDFTFKIEPDTTVNEDGNKFKGVALNTPMTKVTYTNSDKGGSNTKTAEFDFSEVTFEKPGVYYYKVTEEKIDKVPGVSYDTTSYTVQVHVLWNEEQQKPVATYIVGYKEGSKVPIQFKNSLDSTTLTVKKKVSGTGGDRSKDFNFGLTLKANQYYKASEKVMIEKTTKGGQAPVQTEASIDQLYHFTLKDGESIKVTNLPVGVDYVVTEDDYKSEKYTTNVEVSPQDGAVKNIAGNSTEQETSTDKDMTITFTNKKDFEVPTGVAMTVAPYIALGIVAVGGALYFVKKKNA

SEQ ID NO: 7 - protein, 1165 aa, Streptococcus pyogenes
MKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 8 - protein, 292 aa, Streptococcus pyogenes
MIRKYDRTSTKKKSLNWIWLIIAFFMISSFIGGSSFTESLLDILPAIAIGGTGYAIFRVRSHQKRLAKAKIAKQLEDLKAKIQLADRKVRLLDTYLADHDDFQYNVLAQQLLPQLSDIKAKAITLKDQLDPQIYRRITKKANDVESDITLQLETLQIATTLNPQPLKTPSPNLINKAPELKPYYDNIQTDHQAILAKIQGADNQEELLALHDANMRRFEDILTGYLKIKEEPKNYYNAAARLEQAKQAIQQFDEDLDETLRRLNESDLKDFDISLRIMQGATQRRTTHHQKD

SEQ ID NO: 9 - protein, 342 aa, Streptococcus pyogenes
MSLGLVSTALFTLGGCTNNSAKQTTDNSLKIAMITNQTGIDDKSFNQSAWEGLQAWGKENKLEKGKGYDYFQSANESEFTTNLESAVTNGYNLVFGIGFPLHDAVEKVAANNPDNHFAIVDDVIKGQKNVASITFSDHEAAYLAGVAAAKTTKTKQVGFVGGMEGDVVKRFEKGFEAGVKSVDDTIKVRVAYAGSFADAAKGKTIAAAQYAEGADVIYHAAGGTGAGVFSEAKSINEKRKEEDKVWVIGVDRDQSEDGKYTTKDGKSANFVLTSSIKEVGKALVKVAVKTSEDQFPGGQITTFGLKEGGVSLTTDALTQDTKKAIEAAKKAIIEGTITVPEN

SEQ ID NO: 10 - protein, 447 aa, Streptococcus pyogenes
MRNKKVTLAHIVAKTSVAIALAGAMGSSLLANSTTYAVSGKENKKSDVKYETTKVMEANATSSKEDNHVMHTLDGSMSTVWEENSPGGGVGEVLSYKFASPMHIGRILIVNGDTSSKENYYKKNRIAKADVKYYNRNKLVLFQKIELGDTYTKKPHHIEIDKKLDVDRIDIEVTEVHQGQNKDILALSEVTFGNIERDIFEKKFKEIKDKWVTDKQADEFIETADKYADKAVQMSAVASRAEYYRMYVSRKYHYKKEFVEKLKQVYKESGASHVTSKKDVMLAFDDAKKKSTIGRQENGLFVTSFAEDMALLFTDQGKLKSADQIENIKDVDSGKYSDGVYQYEYDSELTKNIDKLGYIRTASGDTPGANSLNVPGCQTWSGKHIENSESELIFPSISVKDLKSKAVLAEIDAKGYFEIIDPTIIAPNGDHKKVTGRFKIKKMQDRK

SEQ ID NO: 11 - protein, 574 aa, Streptococcus pyogenes
MKDMSNKKTFKKYSRVAGLLTAALIIGNLVTANAESNKQNTASTETTTTNEQPKPESSELTTEKAGQKTDDMLNSNDMIKLAPKEMPLESAEKEEKKSEDKKKSEEDHTEEINDKIYSLNYNELEVLAKNGETIENFVPKEGVKKADKFIVIERKKKNINTTPVDISIIDSVTDRTYPAALQLANKGFTENKPDAVVTKRNPQKIHIDLPGMGDKATVEVNDPTYANVSTAIDNLVNQWHDNYSGGNTLPARTQYTESMVYSKSQIEAALNVNSKILDGTLGIDFKSISKGEKKVMIAAYKQIFYTVSANLPNNPADVFDKSVTFKELQRKGVSNEAPPLFVSNVAYGRTVFVKLETSSKSNDVEAAFSAALKGTDVKTNGKYSDILENSSFTAVVLGGDAAEHNKVVTKDFDVIRNVIKDNATFSRKNPAYPISYTSVFLKNNKIAGVNNRTEYVETTSTEYTSGKINLSHQGAYVAQYEILWDEINYDDKGKEVITKRRWDNNWYSKTSPFSTVIPLGANSRNIRIMARECTGLAWEWWRKVIDERDVKLSKEINVNISGSTLSPYGSITYK

SEQ ID NO: 12 - protein, 233 aa, Streptococcus pyogenes
MKKTKLIFSFTSIFIAIISRPVFGLEVDNNSLLRNIYSTIVYEYSDTVIDFKTSHNLVTKKLDVRDARDFFINSEMDEYAANDFKDGDKIAMFSVPFDWNYLSEGKVIAYTYGGMTPYQEEPMSKNIPVNLWINRKQIPVPYNQISTNKTTVTAQEIDLKVRKFLISQHQLYSSGSSYKSGKLVFHTNDNSDKYSLDLFYVGYRDKESIFKVYKDNKSFNIDKIGHLDIEIDS

SEQ ID NO: 13 - protein, 234 aa, Streptococcus pyogenes
MKTNILTIIILSCVFSYGSQLAYADENLKDLKRSLRFAYNITPCDYENVEIAFVTTNSIHINTKQKRSECILYVDSIVSLGITDQFIKGDKVDVFGLPYNFSPPYVDNIYGGIVKHSNQGNKSLQFVGILNQDGKETYLPSEAVRIKKKQFTLQEFDFKIRKFLMEKYNIYDSESRYTSGSLFLATKDSKHYEVDLFNKDDKLLSRDSFFKRYKDNKIFNSEEISHFDIYLKTH

SEQ ID NO: 14 - protein, 275 aa, Streptococcus pyogenes
LRKVLRVKKNIKIARIVPLVLLLVACGRGEVTAQSSSGWDQLVYLFARAIQWLSFDGSIGVGIILFTLTIRLMLMPLFNMQIKSSQKMQDIQPELRELQRKYAGKDTQTRMKLAEESQALYKKYGVNPYASLLPLLIQMPVMIALFQALTRVSFLKTGTFLWVELAQHDHLYLLPVLAAVFTFLSTWLTNLAAKEKNVMMTVMIYVMPLMIFFMGFNLASGVVLYWTVSNAFQVVQLLLLNNPFKIIAERQRLANEEKERRLRERRARKKAMKRK

SEQ ID NO: 15 - protein, 439 aa, Streptococcus pyogenes
MNMKKLASLAMLGASVLGLAACGGKSQKEAGASKSDTAKTEITWWAFPVFTQEKAEDGVGTYEKKLIAAFEKANPEIKVKLETIDFTSGPEKITTAIEAGTAPDVLFDAPGRIIQYGKNGKLADLNDLFTEEFTKDVNNDKLIQASKAGDTAYMYPISSAPFYMALNKKMLKDAGVLDLVKEGWTTDDFEKVLKALKDKGYNPGSFFANGQGGDQGPRAFFANLYSSHITDDKVTKYTTDDANSIKAMTKISNWIKDGLMMNGSQYDGSADIQNFANGQTSFTILWAPAQPGIQAKLLEASKVDYLEIPFPSDDGKPELEYLVNGFAVFNNKDEQKVAASKTFIQFIADDKEWGPKNVVRTGAFPVRTSYGDLYKDKRMEKIAEWTKFYSPYYNTIDGFAEMRTLWFPMVQAVSNGDEKPEDALKAFTEKANKTIKKTQ

SEQ ID NO: 16 - protein, 632 aa, Streptococcus pyogenes
MIQIGKLFAGRYRILKSIGRGGMADVYLANDLILDNEDVAIKVLRTNYQTDQVAVARFQREARAMAELNHPNIVAIRDIGEEDGQQFLVMEYVDGADLKRYIQNHAPLSNNEVVRIMEEVLSAMTLAHQKGIVHRDLKPQNILLTKEGVVKVTDFGIAVAFAETSLTQTNSMLGSVHYLSPEQARGSKATIQSDIYAMGIMLFEMLTGHIPYDGDSAVTIALQHFQKPLPSIIEENHNVPQALENVVIRATAKKLSDRYGSTFEMSRDLMTALSYNRSRERKIIFENVESTKPLPKVASGPTASVKLSPPTPTVLTQESRLDQTNQTDALQPPTKKKKSGRFLGTLFKILFSFFIVGVALFTYLILTKPTSVKVPNVAGTSLKVAKQELYDVGLKVGKIRQIESDTVAEGNVVRTDPKAGTAKRQGSSITLYVSIGNKGFDMENYKGLDYQEAMNSLIETYGVPKSKIKIERIVTNEYPENTVISQSPSAGDKFNPNGKSKITLSVAVSDTITMPMVTEYSYADAVNTLTALGIDASRIKAYVPSSSSATGFVPIHSPSSKAIVSGQSPYYGTSLSLSDKGEISLYLYPEETHSSSSSSSSTSSSNSSSINDSTAPGSNTELSPSETTSQTP

SEQ ID NO: 17 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 18 - protein, 873 aa, Streptococcus pyogenes; identical to SEQ ID NO: 17

SEQ ID NO: 19 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTKLATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNIKQDLAKTTSSLLNAQETLAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESR

SEQ ID NO: 20 - protein, 873 aa, Streptococcus pyogenes
MDLEQPKPNQVKQKIALTSTIALLSASVGVSHHVKADDLAPEGAKASNTSEESLPKTETCEEAKAAVEAVETNLNQQKAELTELATALTKTTAEINHLKEQQDNEQKALTSAQEIYTNTLASSEETLLAQGAEYQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGTNTMKAPQGYPLEELKKLEASGYIGSASYNNYYKEHADQIIAKASPGNQLNQYQDIPADRTRFVDPDNLTPEVQNELAQFAAHMINSVRRQLGLPPVTVTAGSQEFARLLSTSYKKTHGNTRPSFVYGQPGASGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLVAKAKQAQLEATRDQSLAKLASLKAAMHQTKALAEQAAARVTALVAKKAHLQYLRDFKLNPNRLQVIRERIDNTKQDLAKTTSSLLNAQETLAALQAKKSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDIDESTQRALKAGVVMLAAVGLTGVKLRKDTK

SEQ ID NO: 21 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLVAKAKQAQLEATRDQSLAKLASLKAAMHQTKALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKPLSYSKVETTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 22 - protein, 873 aa, Streptococcus pyogenes; identical to SEQ ID NO: 21

SEQ ID NO: 23 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTKLATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 24 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKPLSYSKVETTPLVQEMVKETKHLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 25 - protein, 853 aa, Streptococcus pyogenes
MDLEQTKPNQVKQKIALTSTIALLSASVGVSHQVKADDRASEETKASNTHDDSLPKPETIQEAKATIEAVEKTLSQQKTKLTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKA

SEQ ID NO: 26 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKILANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 27 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 28 - protein, 873 aa, Streptococcus pyogenes
MDLEQTKPNQVKQKIALTSTIALLSASVGVSHQVKADDRASGETKASNTHDDSLPKPETIQEAKATIEAVEKTLSQQKAKLTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 29 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINNLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQETLAALQAKQSSLEATIATTEHQLTLLKTLANEKEYRHLDEDIATVPDLQVAPSLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 30 - protein, 873 aa, Streptococcus pyogenes
MDLEQTKPNQVKQKIALTSTIALLSASVGVSHQVKADDRASGETKASNTHDDSLPKPETIQEAKATIEAVEKTLSQQKAKLTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPKAPVYLGFSTSNVGSLNEHFVMFPESNIANHQRFNKTPIKTVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQETLAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAIGLTGFRFRKESK

SEQ ID NO: 31 - protein, 873 aa, Streptococcus pyogenes
MDLEQTKPNQVKQKIALTSTIALLSASVGVSHQVKADDRASGETKASNTHDDSLPKPETIQEAKATIEAVEKTLSQQKTKLTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMINNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPKAPVYLGFSTSNVGSLNEHFVMFPESNIANHQRFNKTPIKTVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQETLAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 32 - protein, 873 aa, Streptococcus pyogenes
MDLEQTKPNQVKQKIALTSTIALLSASVGVSHQVKADDRASEETKASNTHDDSLPKPETIQEAKATIEAVEKTLSQQKTKLTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 33 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 34 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTKLATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANENEYRHLDEDIATVPDLQVAPPLTGVKPLSYSKIDTTPLVQEMVKETKQLLEASARLAAENTSLVAEALVGQTSEMVASNAIVSKITSSITQPSSKTSYDSGSSTTSNLISDVDESTQRALKAGVVMLAAVGLTGFRFRKESK

SEQ ID NO: 35 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKVPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEVLAEQAAARVTALVAKKAHLQYLRDFKLNPNRLQVIRERIDNTKQDLAKTTSSLLNAQETLAALQAKQSSLEATIATTEHQLTLLKTLANEKGYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 36 - protein, 873 aa, Streptococcus pyogenes
MDLEQTKPNQVKQKIALTSTIALLSASVGVSHQVKADDRASGETKASNTHDDSLPKPETIQEAKATIEAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVSTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKLLSYSKVETTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 37 - protein, 873 aa, Streptococcus pyogenes; identical to SEQ ID NO: 17

SEQ ID NO: 38 - protein, 873 aa, Streptococcus pyogenes; identical to SEQ ID NO: 30

SEQ ID NO: 39 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINNLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKPLSYSKVETTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 40 - protein, 873 aa, Streptococcus pyogenes
MDLEQTKPNQVKQKIALTSTIALLSASVGVSHQVKADDRASGETKASNTHDDSLPKPETIQEAKATIEAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVSTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKPLSYSKVETTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESK

SEQ ID NO: 41 - protein, 879 aa, Streptococcus pyogenes
MEKGERMDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKRNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLEGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESR

SEQ ID NO: 42 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISVETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPKAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESR

SEQ ID NO: 43 - protein, 873 aa, Streptococcus pyogenes
MDLEQTKPNQVKQKIALTSTIALLSASVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQVDQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLVAKAKQAQLEATRDQSLAKLASLKAAMHQTKALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPSLTGVKPLSYSKVETTPLVQEMVKETKQLLEASARLAAENTSLVAEALVGQTSEMVASNAIVSKITSSITQPSSKTSYGSGSSTTSNLISDVDESTQRALKAGVVMLAAVGLTGFRFRKESR

SEQ ID NO: 44 - protein, 873 aa, Streptococcus pyogenes; identical to SEQ ID NO: 43

SEQ ID NO: 45 - protein, 423 aa, Streptococcus pyogenes
MDLILFLLVLVLLGLGAYLLFKVNGLQHQLAQTLEGNADNLSDQMTYQLDTANKQQLLELTQLMNRQQAGLYQQLTDIRDVLHRSLSDSRDRSDKRLEKINQQVNQSLKNMQESNEKRLEKMRQIVEEKLEETLKNRLHASFDSVSKQLESVNKGLGEMRSVAQDVGTLNKVLSNTKTRGILGELQLGQIIEDIMTSSQYEREFVTVSGSSERVEYAIKLPGNGQGGYIYLPIDSKFPLEDYYRLEDAYEVGDKLAIEASRKALLAAIKRFAKDIHKKYLNPPETTNFGVMFLPTEGLYSEVVRNASFFDSLRREENIVVAGPSTLSALLNSLSVGFKTLNIQKNADDISKILGNVKLEFDKFGGLLAKAQKQMNTANNTLDQLISTRTNAIVRALNTVETYQDQATKSLLNMPLLEEENNEN

SEQ ID NO: 46 - protein, 659 aa, Streptococcus pyogenes
VTFMKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDNAVDIPVVALGGTPRVTKAVPFSGGFSWAGSKGPLAYKGMKLQDKPVTVKQYEKAKEKWMKAKAKSNAKYAEKLADHVEK

SEQ ID NO: 47 - protein, 280 aa, Streptococcus pyogenes
MIKKQYLGRATIALASTLVLAACGSSKTAESGNQGSSKEVLFATVGTTAPFSYEKGGQLTGYDIEVAKAVFKGSDDYKVSFKKTEWSSIFTGLDSGKYQMGGNNISFTKERSAKYLFSYPIGSTPSVLVVPKDSDIKSFDDIQGHTTQVVQGTTSVAQLEDFNKKHSDNPVTLKFTNENITQMLTNLSEGKADFKIFDAPTVNAIIKNQGLDNLKTIELTSTEQPFIYFIFSQDQEKLQSFVNKRIKELTADGTLSKLAKEHLGGDYVPSDKELKLPTAN

SEQ ID NO: 48 - protein, 307 aa, Streptococcus pyogenes
LKLTLNRILFSGLALSILLTLTGCVGRDAHGNPKGMIWEFLGKPMSYFIDYFANNAGLGYGLAIIIVTIIVRTLILPLGLYQSWKASYQSEKMAFLKPVFEPINKRIKQANSQEEKMAAQTELMAAQRAHGINPLGGIGCLPLLIQMPFFSAMYFAAQYTKGVSTSTFMGIDLGSRSLVLTAIIAALYFFQSWLSMMAVSEEQREQMKTMMYTMPIMMIFMSFSLPAGVGLYWLVGGFFSIIQQLITTYLLKPRLHKQIKEEYAKNPPKAYQSTSSRKDVTPSQNMEQANLPKKIKSNRNAGKQRKR

SEQ ID NO: 49 - protein, 310 aa, Streptococcus pyogenes
MKKLTLLLTLCLTTITLIACGNQATNHSNTASKSLSPMPQIAGVTYYGDIPKQPKRVVSLASTYTGYLKKLDMNLVGVTSYDKKNPILAKTVKKAKQVAATDLEAVTTLKPDLIVVGSTEENIKQLAEIAPVISIEYRKRDYLQVLSDFGRIFNKEDKAKKWLKDWKTKTAAYEKEVKAVTGDKATFTIMGLYEKDVYLFGKDWGRGGEIIHQAFHYDAPEKVKTEVFKQGYLSLSQEVLPDYIGDYVVVAAEDDKTGSALYESKLWQSIPAVKKHHVIKVNANVFYFTDPLSLEYQLETLREAILSSEN

SEQ ID NO: 50 - protein, 1647 aa, Streptococcus pyogenes
VEKKQRFSLRKYKSGTFSVLIGSVFLVMTTTVAADELSTMSEPTITNHAQQQAQHLTNTELSSAESKSQDTSQITLKTNREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKNAQGNPVLAISPNGDNNQDFAAFKGVFLRKYQGLKASVYHASDKEHKNPLWVSPESFKGDKNFNSDIRFAKSTTLLGTAFSGKSLTGAELPDGHYHYVVSYYPDVVGAKRQEMTFDMILDRQKPVLSQATFDPETNRFKPEPLKDRGLAGVRKDSVFYLERKDNKPYTVTINDSYKYVSVEDNKTFVERQADGSFILPLDKAKLGDFYYMVEDFAGNVAIAKLGDHLPQTLGKTPIKLKLTDGNYQTKETLKDNLEMTQSDTGLVTNQAQLAVVHRNQPQSQLTKMNQDFFISPNEDGNKDFVAFKGLKNNVYNDLTVNVYAKDDHQKQTPIWSSQAGASVSAIESTAWYGITARGSKVMPGDYQYVVTYRDEHGKEHQKQYTISVNDKKPMITQGRFDTINGVDHFTPDKTKALDSSGIVREEVFYLAKKNGRKFDVTEGKDGITVSDNKVYIPKNPDGSYTISKRDGVTLSDYYYLVEDRAGNVSFATLRDLKAVGKDKAVVNFGLDLPVPEDKQIVNFTYLVRDADGKPIENLEYYNNSGNSLILPYGKYTVELLTYDTNAAKLESDKIVSFTLSADNNFQQVTFKITMLATSQITAHFDHLLPEGSRVSLKTAQDQLIPLEQSLYVPKAYGKTVQEGTYEVVVSLPKGYRIEGNTKVNTLPNEVHELSLRLVKVGDASDSTGDHKVMSKNNSQALTASATPTKSTTSATAKALPSTGEKMGLKLRIVGLVLLGLTCVFSRKKSTKD

SEQ ID NO: 51 - protein, 420 aa, Streptococcus pyogenes
MTKEKLVAFSQAHAEPAWLQERRLAALEAIPNLELPTIERVKFHRWNLGDGTLTENESLASVPDFIAIGDNPKLVQVGTQTVLEQLPMALIDKGVVFSDFYTALEEIPEVIEAHFGQALAFDEDKLAAYHTAYFNSAAVLYVPDHLEITTPIEAIFLQDSDSDVPFNKHVLVIAGKESKFTYLERFESIGNATQKISANISVEVIAQAGSQIKFSAIDRLGPSVTTYISRRGRLEKDANIDWALAVMNEGNVIADFDSDLIGQGSQADLKVVAASSGRQVQGIDTRVTNYGQRTVGHILQHGVILERGTLTFNGIGHILKDAKGADAQQESRVLMLSDQARADANPILLIDENEVTAGHAASIGQVDPEDMYYLMSRGLDQETAERLVIRGFLGAVIAEIPIPSVRQEIIKVLDEKLLNR

SEQ ID NO: 52 - protein, 232 aa, Streptococcus pyogenes
MKRIIKTIILVIIIFHGYGSVKSDSENIKDVKLQLNYAYEIIPVDYTNCNIDYLTTHDFYIDISSYKKKNFSVDSEVESYITTKFTKNQKVNIFGLPYIFTRYDVYYIYGGVTPSVNSNSENSKIVGNLLIDGVQQKTLINPIKIDKPIFTIQEFDFKIRQYLMQTYKIYDPNSPYIKGQLEIAINGNKHESFNLYDATSSSTRSDIFKKYKDNKTINMKDFSHFDIYLWTK

SEQ ID NO: 53 - protein, 319 aa, Streptococcus pyogenes
MKLAVLGTGMIVKEVLPVLQKIDGIDLVAILSTVRSLTTAKDLAKAHHMPLATSKYEAILGNEEIDTVYIGLPNHLHFAYAKEALLAGKHVICEKPFTMTAGELDELVVIARKRKLILLEAITNQYLSNMTFIKEHLDQLGDIKIVECNYSQYSSRYDAFKRGDIAPAFNPKMGGGALRDLNIYNIHFVVGLFGRPKTVQYLANVEKGIDTSGMLVMDYEQFKVVCIGAKDCTAEIKSTIQGNKGSLAVLGATNTLPQVQLSLHGHEPQVINHNKHDHRMYEEFVAFRDMIDQRDFEKVNQALEHSRAVMAVLERAVHS

SEQ ID NO: 54 - protein, 268 aa, Streptococcus pyogenes
MKKLLSLSLVAISLLNLSACESVDRAIKGDKYIDEKTAKEESEAASKAYEESIQKALKADASQFPQLTKEVGKEEAKVVMRTSQGDITLKLFPKYAPLAVENFLTHAKKGYYDNLTFHRVINDFMIQSGDPKGDGTGGESIWKGKDPKKDAGNGFVNEISPFLYHIRGALAMANAGANTNGSQFYINQNKKNQSKGLSSTNYPKPIISAYEHGGNPSLDGGYTVFGQVIDGMDVVDKIAATSINQNDKPEQDITITSIDIVKDYRFKN

SEQ ID NO: 55 - protein, 389 aa, Streptococcus pyogenes
MIITKKSLFVTSVALSLVPLATAQAQEWTPRSVTEIKSELVLVDNVFTYTVKYGDTLSTIAEAMGIDVHVLGDINHIANIDLIFPDTILTANYNQHGQATNLTVQAPASSPASVSHVPSSEPLPQASATSQPTVPMAPPATPSDVPTTPFASAKPDSSVTASSELTSSTNDVSTELSSESQKQPEVPQEAVPTPKAAETTEVEPKTDISEAPTSANRPVPNESASEEVSSAAPAQAPAEKEETSAPAAQKAVADTTSVATSNGLSYAPNHAYNPMNAGLQPQTAAFKEEVASAFGITSFSGYRPGDPGDHGKGLAIDFMVPENSALGDQVAQYAIDHMAERGISYVIWKQRFYAPFASIYGPAYTWNPMPDRGSITENHYDHVHVSFNA

SEQ ID NO: 56 - protein, 235 aa, Streptococcus pyogenes
MKKINIIKIVFIITVILISTISPIIKSDSKKDISNVKSDLLYAYTITPYDYKNCRVNFSTTHTLNIDTQKYRGKDYYISSEMSYEASQKFKRDDHVDVFGLFYILNSHTGEYIYGGITPAQNNKVNHKLLGNLFISGESQQNLNNKIILEKDIVTFQEIDFKIRKYLMDNYKIYDATSPYVSGRIEIGTKDGKHEQIDLFDSPNEGTRSDIFAKYKDNRIINMKNFSHFDIYLEK

SEQ ID NO: 57 - protein, 515 aa, Streptococcus pyogenes
MKKKILLMMSLISVFFAWQLTQAKQVLAEGKVKVVTTFYPVYEFTKGVIGNDGDVFMLMKAGTEPHDFEPSTKDIKKIQDADAFVYMDDNMETWVSDVKKSLTSKKVTIVKGTGNMLLVAGAGHDHPHEDADKKHEHNKHSEEGHNHAFDPHVWLSPYRSITVVENIRDSLSKAYPEKAENFKANAATYIEKLKELDKDYTAALSDAKQKSFVTQHAAFGYMALDYGLNQISINGVTPDAEPSAKRIATLSKYVKKYGIKYIYFEENASSKVAKTLAKEAGVKAAVLSPLEGLTEKEMKAGQDYFTVMRKNLETLRLTTDVAGKEILPEKDTTKTVYNGYFKDKEVKDRQLSDWSGSWQSVYPYLQDGTLDQVWDYKAKKSKGKMTAAEYKDYYTTGYKTDVEQIKINGKKKTMTFVRNGEKKTFTYTYAGKEILTYPKGNRGVRFMFEAKEADAGEFKYVQFSDHAIAPEKAKHFHLYWGGDSQEKLHKELEHWPTYYGSDLSGREIAQEINAH

SEQ ID NO: 58 - protein, 2059 aa, Streptococcus pyogenes
MFLKHQDVKQKNWRMRKVKKVFVSSCMLLTVGLGVAVPTGFSQSNGVMVVKAAEVPATDLSRQASDSERVDESSLLQKENLSVDSFKLENLNGWEAENDTAGNLGKFKDPDSSGYQNILTSSGKNISVAVAPKGSGKMNIKVTKRSNFQGGYYVGGLRTQTPVLKLNDVYRYSFTTKKLSGNSSEFKTRVKPVESNNKLGKELVIRVDNKNVSTKHDWLPDISDGTHTVDFTGLDKKLSVAFRFSPRQTSNVVYEFSNINIKNISPASVPAIPSKVLEGTSVLSGTAISSGDTLEKRKSFDGDILRVYKDSKIIARTVIKGNKWDVKLSKPLIAGEKLDFEILHPRSQNVSKKISKQVEAKPFDPASYKEKVIAKLKPVYEATSEKITNDAWLDENAKDLQKQKLEEQYISGKVAISEAGTKQEAIDAAYNKYSSQTDPDSLPSQYKQGNKENEQEKGRQDLIQTRDLTLKAIQEDKWLTEQEKTIQKEEALKAFETGIESVNQTVSLEQLKQRLIVYKASEKDSEKKEYPESIPNQHIPGKEKEVKAAKQEELKKLHDTTLEKINQDKWLTPDQQAEQLKQAEVTFKKGQEAIKSAQTLTQLETDLADYVSENEGKGNSIPDKYKSGNKDDLVNKAEVKLKEAHEATKQAIEKDPWLSPEQKKAQKEKAKARLDEGLKALKAADSLEILKVTEEAFVDKEKNPDSIPNQHKAGTADQARKQALDSLDKEVQKELESIDNDNTLTTDEKAAAKKKVNDAYDVAKQTAMEANSYEDLTTIKDEFLSNLPHKQGTPLKDQQSDAIAELEKKQQEIEKAIEGDKTLPRDEKEKQIADSKERLKSDTQKVKDAKNADAIKKAFEEGKVNIPQAHIPGDLNKDKEKLLAELKQKADDTEKAIDVDKTLTEDEKKEQKVKTKAELEKAKTDVKNTQTREELDKKVPELKKAIEDTHVKGNLEGVKNKAIEDLKKAHTETVAKINGDDTLDKATKEAQVKEADKALAAGKDAITKADDADKVSTAVTEHTPKIKAAHKTGDLKKAQVDANTALDKAAEKERGEINKDATLTTEDKAKQLKEVETALTKAKDNVKAAKTADAINDARDKGVATIDAVHKAGQDLGARKSGQVAKLEEAAKATKDKISADPTLTSKEKEEQSKAVDAELKKAIEAVNAADTADKVDDALGEGVTDIKNQHKSGDSIDARREAHGKELDRVAQETKGAIEKDPTLTTEEKAKQVKDVDAAKERGMAKLNEAKDADALDKAYGEGVTDIKNQHKSGDPVDARRGLHNKSIDEVAQATKDAITADTTLTEAEKETQRGNVDKEATKAKEELAKAKDADALDKAYGDGVTSIKNQHKSGKGLDVRKDEHKKALEAVAKRVTAEIEADPTLTPEVREQQKAEVQKELELATDKIAEAKDADEADKAYGDGVTAIENAHVIGKGIEARKDLAKKDLAEAAAKTKALIIEDKTLTDDQRKEQLLGVDTEYAKGIENIDAAKDAAGVDKAYSDGVRDILAQYKEGQNLNDRRNAAKEFLLKEADKVTKLINDDPTLTHDQKVDQINKVEQAKLDAIKSVDDAQTADAINDALGKGIENINNQYQHGDGVDVRKATAKGDLEKEAAKVKALIAKDPTLTQADKDKQTAAVDAAKNTAIAAVDKATTTEGINQELGKGITAINKAYRPGEGVKARKEAAKADLEKEAAKVKALITNDPTLTKADKAKQTEAVAKALKAAIAAVDKATTAEGINQELGKGITAINKAYRPGEGVKARKEAAKADLEREAAKVREAIANDPTLTKADKAKQTEAVAKALKAAIAAVDKATTAEGINQELGKGITAINKAYRPGEGVEAHKEAAKANLEKVAKETKALISGDRYLSETEKAVQKQAVEQALAKALGQVEAAKTVEAVKLAENLGTVAIRSAYVAGLAKDTDQATAALNEAKQAAIEALKQAAAETLAKITTDAKLTEAQKAEQSENVSLALKTAIATVRSAQSIASVKEAKDKGITAIRAAYVPNKAVAKSSSANHLPKSGDANSIVLVGLGVMSLLLGMVLYSKKKESKD

SEQ ID NO: 59 - protein, 270 aa, Streptococcus pyogenes
MNFKKIRFGFLLCLLLYPLAACNKSEQLNHYERIKKTRKLVVAVSPDYAPFEFKALVNGKDTIVGADVQLAQAIADELDVDLELSPMSFDNVLSSLQTGKADLAISGISHTKERAKVYDFSIPYYQAENAIVMRASDAKVTKNISDLNGKKVAAQKGSIEEGLVKIQLPKANLISLTAMGEAINELKAGQVYAVTLEAPVAAGFLAQHKDLALAPFSLKTSDGDAKAVALPKNSGDLTKAVNKVIAKLDEQERYKSFIAETIALTKNTMK

SEQ ID NO: 60 - protein, 267 aa, Streptococcus pyogenes
MNFLTKKNRILLREMVKTDFKLRYQGSAIGYLWSILKPLMMFTIMYLVFIRFLRLGGNVPHFPVALLLANVIWSFFSEATSMGMVSIVSRGDLLRKLNFSKHIIVFSAVLGALINFLINLVVVLIFALINGVTISGYAYLSLFLFIELVVLVLGIALLLSNVFVYYRDLAQVWEVLLQAGMYATPIIYPITFVLDSHPLAAKLLMLNPVAQMIQDFRYLLIDRANVTIWQMSTNWFYIVIPYLVPFVILFIGIFVFKKNADRFAEII

SEQ ID NO: 61 - protein, 299 aa, Streptococcus pyogenes
MLYYSYLNKGVTMKKSVTLLSIGLASLLLAACAPHQSQKSSWDTIKEKGVLKVATPGTYQPTSFYNDNNELVGYEVDMVKEIGKRLNIKVKFVETGFDQAFTSVDSGRVDISLNNFDITPKRQKKYNISTPYKYGVGGMIVRADGSSNIAKKDLSDWKGKKAAGASGTEYMKVAQKQGAELVTYDNVTGDVYLNDVANGRTDFIPNDYPAQKLFVDYMLSQNPNLNVKMSDVQYNPTEQGIVMNKKDDSLKKKIDAVIKDMIKDGSLKKISETYYAGQDLTKPFGKDKKIPVIDTKDVN

SEQ ID NO: 62 - protein, 236 aa, Streptococcus pyogenes
MRYNCRYSHIDKKIYSMIICLSFLLYSNVVQANSYNTTNRHNLESLYKHDSNLIEADSIKNSPDIVTSHMLKYSVKDKNLSVFFEKDWISQEFKDKEVDIYALSAQEVCECPGKRYEAFGGITLTNSEKKEIKVPVNVWDKSKQQPPMFITVNKPKVTAQEVDIKVRKLLIKKYDIYNNREQKYSKGTVTLDLNSGKDIVFDLYYFGNGDFNSMLKIYSNNERIDSTQFHVDVSIS

SEQ ID NO: 63 - protein, 805 aa, Streptococcus pyogenes
VNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 64 - protein, 318 aa, Streptococcus pyogenes
MKRFLNSRPWLGMVSVFFAILLFLTAASSNHNNSSSQIYSPIETYTHSLKDVPIDMKYDSDKYFISGYSYGAEVYLTSTNRIKLDSEVNNDTRNFKIVADLTHSHPGTVSVNLRVENLPSGVTATVSPDKISVTIGKKESKVFPVRGSVDAKQIANGYEISKIETGVNKVEVTSDESTIALIDHVVAKLPDDQVLDRNYSSRVTLQAVSADGTILASAIDPAKTNLSVAVKKITKSVPIRVEAVGMMDDSLSDIQYKLSKQTAVISGSREVLEDIDEIIAEVNISDVTKNTSKTVSLSSSQVSIEPSVVTVQLTTTKK

SEQ ID NO: 65 - protein, 293 aa, Streptococcus pyogenes
LLTFGGASAVKAEENEKVREQEKLIQQLSEKLVEINDLQTLNGDKESIQSLVDYLTRRGKLEEEWMEYLNSGIQRKLFVGPKGPAGEKGEQGPTGKQGERGETGPAGPRGDKGETGDKGAQGPVGPAGKDGQNGKDGLPGKDGKDGQNGKDGLPGKDGKDGQDGKDGLPGKDGKDGQNGKDGLPGKDGQPGKPAPKTPEVPQNPDTAPHTPKTPRIPGQSKDVTPAPQNPSNRGLNKPQTQGGNQLAKTPAAHDTHRQLPATGETTNPFFTAAAVAIMTTAGVVAVAKRQENN

SEQ ID NO: 66 - protein, 320 aa, Streptococcus pyogenes
MNNRHKRRQKRKAFTLINLILLFACILGLTLIFYLYQGSNKFGLSDVSRFVPKISLFHHKKTAKKETTKLKKTHFDSSKSQKKAHSKLTWTKQETPVKIPILMYHAIHVMSPEETANANLIVNPDLFDQQLQKMKDEGYYFLSPEEVYRALSNNELPAKKVVWLTFDDSMIDFYNVAYPILKKYDAKATNNVITGLTEMGSAANLTLKQMKEMKQVGMSFQDHTVNHPDLEQASPDVQTTEMKDSKDYLDKQLNQNTIAIAYPSGRYNDTTLQIAARLNYKLGVTTNEGIASAANGLLSLNRIRILPNMSPENLLQTMEP

SEQ ID NO: 67 - protein, 350 aa, Streptococcus pyogenes
MNKKFIGLGLASVAVLSLAACGNRGASKGGASGKTDLKVAMVTDTGGVDDKSFNQSAWEGLQSWGKEMGLQKGTGFDYFQSTSESEYATNLDTAVSGGYQLIYGIGFALKDAIAKAAGDNEGVKFVIIDDIIEGKDNVASVTFADHEAAYLAGIAAAKTTKTKTVGFVGGMEGTVITRFEKGFEAGVKSVDDTIQVKVDYAGSFGDAAKGKTIAAAQYAAGADVIYQAAGGTGAGVFNEAKAINEKRSEADKVWVIGVDRDQKDEGKYTSKDGKEANFVLASSIKEVGKAVQLINKQVADKKFPGGKTTVYGLKDGGVEIATTNVSKEAVKAIKEAKAKIKSGDIKVPEK

SEQ ID NO: 68 - protein, 288 aa, Streptococcus pyogenes
MKMKKKFFLLSLLALSTFFLSACSSWIDKGESITAVGSTALQPLVEAVADEFGSSNLGKTVNVQGGGSGTGLSQVQSGAVQIGNSDVFAEEKDGIDASKLVDHQVAVAGLAVIANPKVKVSNLSSQQLQKIFSGEYTNWKQVGGEDLAISVINRAASSGSRATFDSVIMKGVNAKQSQEQDSNGMVKSIVSQTPGAISYLSFAYVDSSVKSLQLNGFKANAKNVATNDWPIWSYEHMYTKDKPTGLTKEFLDYMFSDEVQQNIVTHMGYISINDMEVVKSHDGKVTKR

SEQ ID NO: 69 - protein, 257 aa, Streptococcus pyogenes
MKPKHLLCLSTVVAGLALFSTMTHSVLADDASNPDAILMNNNQANFQRDALVQKLDEGHQQLEAIKHEAKGTDIETTVNKAIDAVDHMKSSIRFNTETIYDFSSIGARVEALSDAIKAIVFSTTQLTHKVEKAHTDMGFAITKLVIRIIDPFASVDAIKAQVQEIKALEEKVINYPDLQPTDRATIYTKAKLNKAIWNTRLERDKKVLGIKPFDVYNRLNKAITHAVGVQLNPTTTVQQVDDEVIAVQDALETALKS

SEQ ID NO: 70 - protein, 278 aa, Streptococcus pyogenes
MIIKKRTVAILAIASSFFLVACQATKSLKSGDAWGVYQKQKSITVGFDNTFVPMGYKDESGRCKGFDIDLAKEVFHQYGLKVNFQAINWDMKEAELNNGKIDVIWNGYSITKERQDKVAFTDSYMRNEQIIVVKKRSDIKTISDMKHKVLGAQSASSGYDSLLRTPKLLKDFIKNKDANQYETFTQAFIDLKSDRIDGILIDKVYANYYLAKEGQLENYRMIPTTFENEAFSVGLRKEDKTLQAKINRAFRVLYQNGKFQAISEKWFGDDVATANIKS

SEQ ID NO: 71 - protein, 206 aa, Streptococcus pyogenes
MTKKHLLTLLLISFFTSFLVACSTTKDKEPQPSDSEIITPRLHQAAHQDKRANFEKIKLATVDSSFTGGTSLEELISLFGEPSQHDPKTAGEVTIDAYTWQFDQVTLTVNLYQNSSIVKTISNFTFARELGLSQKEYQQLQKGMSYEDVKKILTEPDNYSQASSSDHQTLQAIWVSGLKTDTSGANISLVFENNQLTEMSQVGLEE

SEQ ID NO: 72 - protein, 415 aa, Streptococcus pyogenes
MKSWQKVIVGGASLTLASTLLVGCGSGSKDKKEAGADSKTIKLWVPTGSKKSYADTIAKFEKDSGYTVKVVESEDPKAQEKIKKDASTAADVFSLPHDQLGQLVESGTIQEVPEKYNKEIAATSTDQALVGAQYKGKTYAFPFGIESQVLFYNKSKLAAEDVTSYDTITTKATFGGTFKQANTYATGPLFMSVGNTLFGENGEDVKGTNWGNEKGAAVLKWIADQASNKGFVSLDANNVMSKFGDGSVASFESGPWDYEAAQKAIGKENLGVAIYPKVTIGGETVQQKAFLGVKLYAVNQAPAKGDTKRIAASYKLASYLTNAESQENQFKTRNIVPANKEVQSSEAVQSNELAKTVITMGSSSDYTVVMPKLSQMGTFWTESAAILSDAFNGKIKENDYLTKLQQFDKDIAATK

SEQ ID NO: 73 - protein, 711 aa, Streptococcus pyogenes
MRELHIKTYKLLTKSAVLLGLISFPLTVSAADNASVTNKADFSTDTIYQIVTDRFNDGNTSNNGKTDVFDKNDLKKYHGGDWQGIIAKIKDGYLTDMGISAIWISSPVENIDSIDPSNGSAAYHGYWAKDFFKTNQHFGTEADFQQLVKVAHQHHIKVVIDFAPNHTSTAEKEGTTFKEDGALYKNGKLVGKFSDDKDKIFNHESWTDFSTYENSIYHSMYGLADLNNINPKVDQYMKEAIDKWLDLGVDGIRVDAVKHMSQGWQKNWLSHIYEKHNVFVFGEWFSGHTDDDYDMTTFANNSGMGLLDFRFANAIRQLYTGFSTFTMRDFYKVLENRDQVTNEVTDQVTFIDNHDMERFATKVANNQTAVNQAYALLLTSRGVPNIYYGTEQYATGDKDPNNRGDMPSFNKESQAYKVISKLAPLRKQNQALAYGTTEQRWISDHVLVFERKFGNHVALVAINRDQTNGYTITNAKTALPQNSYKDKLEGLLGGQELIVGADGTISSFELGAGQVAVWTYEGEDKTPQLGDVDASVGIAGNKITISGQGFGNSKGQVTFGEISAEILSWSDTLITLKVPTVPANYYNISVTTADKQTSNSYQAFEVLTDKQIPVRLLINDFKTVPGEQLYLMGDVFEMGANDAKNAVGPLFNNTQTIAKYPNWFFDTHLPINKEIAVKLVKKDSIGNVLWTSPETYSIKTGHEAQTITIKK

SEQ ID NO: 74 - protein, 792 aa, Streptococcus pyogenes
MKTKKVIILVGLLLSSQLTLIACQSRGNGTYPIKTKQSRKGMTSNKIKPIKKSKKTNKTHKGVAGVDFPTDDGFILTKDSKILSKTDQGIVVDHDGHSHFIFYADLKGSPFEYLIPKGASLAKPAVAQRAASQGTSKVADPHHHYEFNPADIVAEDALGYTVRHDDHFHYILKSSLSGQTQAQAKQVATRLPQTSSLVSTATANGIPGLHFPTSDGFQFNGQGIVGVTKDSILVDHDGHLHPISFADLRQGGWAHVADQYDPAKKAEKPAETHQTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNISLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 75 - protein, 351 aa, Streptococcus pyogenes
MKNSNKLIASVVTLASVMALAACQSTNDNTKVISMKGDTISVSDFYNETKNTEVSQKAMLNLVISRVFEAQYGDKVSKKEVEKAYHKTAEQYGASFSAALAQSSLTPETFKRQIRSSKLVEYAVKEAAKKELTTQEYKKAYESYTPTMAVEMITLDNEETAKSVLEELKAEGADFTAIAKEKTTTPEKKVTYKFDSGATNVPTDVVKAASSLNEGGISDVISVLDPTSYQKKFYIVKVTKKAEKKSDWQEYKKRLKAIIIAEKSKDMNFQNKVIANALDKANVKIKDKAFANILAQYANLGQKTKAASESSTTSESSKAAEENPSESEQTQTSSAEEPTETEAQTQEPAAQ

SEQ ID NO: 76 - protein, 195 aa, Streptococcus pyogenes
MKKKSNLNWWKWSFLCLLAFNTAFLMVIASRLIQVREPESELIAKKPVKNIKIGTFVTTREQLNETVASYLKDYQTEKMSYKFYATSSSILFEGTYQLLGYEVPLYIYFQPHRLENGAVQLQVISFSVGTLPLPEKDVLQYLKSSYKLPSFVKVMPNQSAIVVNLQDIQNDAKVYLKAKKIDLFNDEISFNIYKK

SEQ ID NO: 77 - protein, 207 aa, Streptococcus pyogenes
MKKGLLVTTGLACLGLLTACSTQDNMAKKEITQDKMSMAAKKKDKMSTSKDKSMMADKSSDKKMTNDGPMAPDFELKGIDGKTYRLSEFKGKKVYLKFWASWCSICLSTLADTEDLAKMSDKDYVVLTVVSPGHQGEKSEADFKKWFQGTDYKDLPVLLDPDGKLLEAYGVRSYPTEVFIGSDGVLAKKHIGYAKKSDIKKTLKGIH

SEQ ID NO: 78 - protein, 380 aa, Streptococcus pyogenes
MKKWQKIVCVTGTVLATSNLAACESKSASKDSDVKLLMYQVGDKPDNFDELMTIANKRIKEKTGATVDLQYIGWGDWDDKMSTIIASGENYDIAFANNYVVNAQKGAFADLTTLMPKYAKKTYKNLDPAYIKGNTIDGKLYAFPVDANVYAQQMLSFNKELVDKYGLDISNIKSYADAENVLKQFHEKEPNTAAFAIGQVFSMSGDYDYPLTKTQPFAVKIDEGKPTIINQYEDESFKNNLRLMHKWYKEGLIPTDAATNTEGYPLEGNTWFMREETQGPMDYGDTILTNAAGKDIVSRPLTKPLKTTSQAQMANFVVSSVSKNKEKAVEVLSLLNSDPELLNGLVYGVEGKAWEKIGDKKIKLLDGYQPKNAHGCLEYW

SEQ ID NO: 79 - protein, 535 aa, Streptococcus pyogenes
MVNIILLIVSALIGLILGYALISIRLKSAKEAAELTLLNAEQEAVDIRGKAEVDAEHIKKTAKRESKANRKELLLEAKEEARKYREEIEQEFKSERQELKQLETRLAERSLTLDRKDENLSSKEKVLDSKEQSLTDKSKHIDERQLQVEKLEEEKKAELEKVAAMTIAEAREVILMETENKLTHEIATRIRDAERDIKDRTVKTAKDLLAQAMQRLAGEYVTEQTITSVHLPDDNMKGRIIGREGRNIRTLESLTGIDVIIDDTPEVVILSGFDPIRREIARMTLESLIADGRIHPARIEELVEKNRLEMDNRIREYGEAAAYEIGAPNLHPDLIKIMGRLQFRTSFGQNVLRHSVEVGKLAGILAGELGENVALARRAGFLHDMGKAIDREVEGSHVEIGMEFARKYKEHPVVVNTIASHHGDVEPDSVIAVLVAAADALSSARPGARNESMENYIKRLRDLEEIATSFDGVQNSFALQAGREIRIMVQPEKISDDQVVILSHKVREKIENNLDYPGNIKVTVIREMRAVDYAK

SEQ ID NO: 80 - protein, 424 aa, Streptococcus pyogenes
MKIGKKIVLMFTAIVLTTVLALGVYLTSAYTFSTGELSKTFKDFSTSSNKSDAIKQTRAFSILLMGVDTGSSERASKWEGNSDSMILVTVNPKTKKTTMTSLERDTLTTLSGPKNNEMNGVEAKLNAAYAAGGAQMAIMTVQDLLNITIDNYVQINMQGLIDLVNAVGGITVTNEFDFPISIAENEPEYQATVAPGTHKINGEQALVYARMRYDDPEGDYGRQKRQREVIQKVLKKILALDSISSYRKILSAVSSNMQTNIEISSRTIPSLLGYRDALRTIKTYQLKGEDATLSDGGSYQIVTSNHLLEIQNRIRTELGLHKVNQLKTNATVYENLYGSTKSQTVNNNYDSSGQAPSYSDSHSSYANYSSGVDTGQSASTDQDSTASSHRPATPSSSSDALAADESSSSGSGSLVPPANINPQT

SEQ ID NO: 81 - protein, 294 aa, Streptococcus pyogenes
MIKRCKGIGLALMAFFLVACVNQHPKTAKETEQQRIVATSVAVVDICDRLNLDLVGVCDSKLYTLPKRYDAVKRVGLPMNPDIELIASLKPTWILSPNSLQEDLEPKYQKLDTEYGFLNLRSVEGMYQSIDDLGNLFQRQQEAKELRQQYQDYYRAFQAKRKGKKKPKVLILMGLPGSYLVATNQSYVGNLLDLAGGENVYQSDEKEFLSANPEDMLAKEPDLILRTAHAIPDKVKVMFDKEFAENDIWKHFTAVKEGKVYDLDNTLFGMSAKLNYPEALDTLTQLFDHVGDHP

SEQ ID NO: 82 - protein, 506 aa, Streptococcus pyogenes
MNKNKLLRVAMLLSLLAPTAESMTVLAQDVMLETHKATTNETSDSSSKEENNKNAAPTTSDKTDQGPLDASAETNSNSLVNADDKKRSDSSQSAIGSSDNKAEAENQVDDKSTDHSKSTDHSKPTDQPKPSPSKVDTAPASSLSKQLPEARTPIQSLSPYVSDLDLSEIDIPSVNTYAAYVEHWSGKNAYTHHLLSRRYGIKADQIDSYLKSTGIAYDSTRINGEKLLQWEKKSGLDVRAIVAIAMSESSLGTQGIATLLGANMFGYAAFDLDPTQASKFNDDSAIVKMTQDTIIKNKNSNFALQDLKAAKFSRGQLNFASDGGVYFTDTTGSGKRRAQIMEDLDKWIDDHGGTPAIPAELKVQSSASFASVPAGYKLSKSYDVLGYQASSYAWGQCTWYVYNRAKELGYQFDPFMGNGGDWKYKVGYALSKTPKVGYAISFAPGQAGADGTYGHVSIVEDVRKDGSILISESNCIGLGKISYRTFTAQQAEQLTYVIGKSKNGAS

SEQ ID NO: 83 - protein, 284 aa, Streptococcus pyogenes
MKSKKVVSVISLTLSLFLVTGCAKVDNNKSVNLKPATKQTYNSYSDDQLRSRENTMSVLWYQRAAETQALYLQGYQLATDRLKEQLNKPTDKPYSIVLDIDETVLDNSPYQAKNVLEGTGFTPESWDYWVQKKEAKPVAGAKDFLQFADQNGVQIYYISDRSTTQVDATMENLQKEGIPVQGRDHLLFLEKGVKSKESRRQKVKETTNVTMLFGDNLLDFADFSKKSQEDRTALLSDLQEEFGRRFIIFPNPMYGSWEGAIYKGEKLDVLKQLEERRKSLKSFK

SEQ ID NO: 84 - protein, 440 aa, Streptococcus pyogenes
MKNYLSIGVIALLFALTFGTVKSVQAIAGYGWLPDRPPINNSQLVVSMAGIVEGTDKKVFINFFEIDLTSQPAHGGKTEQGLSPKSKPFATDNGAMPHKLEKADLLKAIQKQLIANVHSNDGYFEVIDFASDATITDRNGKVYFADKDGSVTLPTQPVQEFLLKGHVRVRPYKEKPVQNQAKSVDVEYTVQFTPLNPDDDFRPGLKDTKLLKTLAIGDTITSQELLAQAQSILNKTHPGYTIYERDSSIVTHDNDIFRTILPMDQEFTYHVKNREQAYEINPKTGIKEKTNNTDLVSEKYYVLKQGEKPYDPFDRSHLKLFTIKYVDVNTNELLKSEQLLTASERNLDFRDLYDPRDKAKLLYNNLDAFDIMDYTLTGKVEDNHDKNNRVVTVYMGKRPKGAKGSYHLAYDKDLYTEEERKAYSYLRDTGTPIPDNPKDK

SEQ ID NO: 85 - protein, 542 aa, Streptococcus pyogenes
MSKYLKYFSIITLFLTGLILVACQQQKPQTKERQRKQRPKDELVVSMGAKLPHEFDPKDRYGVHNEGNITHSTLLKRSPELDIKGELAKTYHLSEDGLTWSFDLHDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELADKKVKGTRLLDIPSNDVRGLSLPYVKKGVITDSPDGYPVGNDVTSDPAIRKALTIGLNRQKVLDTVLNGYGKPAYSIIDKTPFWNPKTAIKDNKVAKAKQLLTKAGWKEQADGSRKKGDLDAAFDLYYPTNDQLRANLAVEVAEQAKALGITIKLKASNWDEMATKSHDSALLYAGGRHHAQQFYESHHPSLAGKGWTNITFYNNPTVTKYLDKAMTSSDLDKANEYWKLAQWDGKTGASTLGDLPNVWLVSLNHTYIGDKRINVGKQGVHSHGHDWSLLTNIAEWTWDESTK

SEQ ID NO: 86 - protein, 306 aa, Streptococcus pyogenes
MKKGFFLMAMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVDVFEASKPLTLDRVKGLEDMEVTQGIDPATLYDPHTWTDPVLAGEEAVNIAKELGRLDPKHKDSYTKNAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 87 - protein, 308 aa, Streptococcus pyogenes
MNIRNKIENSKTLLFTSLVAVALLGATQPVSAETYTSRNFDWSGDDWSGDDWPEDDWSGDGLSKYDRSGVGLSQYGWSKYGWSSDKEEWPEDWPEDDWSSDKKDETEDKTRPPYGEALGTGYEKRDDWGGPGTVATDPYTPPYGGALGTGYEKRDDWGGPGTVATDPYTPPYGGALGTGYEKRDDWRGPGHIPKPENEQSPNPLHIPEPPQIEWPQWNGFDGLSFGPSDWGQSEDTPPSEPRVPEKPQHTPQKNPQESDFDRGFSAGLKAKNSGRGIDFEGFQYGGWSDEYKKGYMQAFGTPYTPSAT

SEQ ID NO: 88 - protein, 309 aa, Streptococcus pyogenes
MKQMNKLITGVVTLATVVTLSACQSSHNNTKLVSMKGDTITVSDFYNETKNTELAQKAMLSLVISRVFETQYANKVSDKEVEKAYKQTADQYGTSFKTVLAQSGLTPETYKKQIRLTKLVEYAVKEQAKNETISKKDYRQAYDAYTPTMTAEIMQFEKEEDAKAALEAVKAEGADFAAIAKEKTTAADKKTTYTFDSGETTLPAEVVRAASGLKEGNRSEIITALDPATSKRTYHIIKVTKKATKKADWKAYQKRLKDIIVTGKLKDPDFQNKVIAKALDKANVKIKDKAFANILAQFAKPNQKQPAQK

SEQ ID NO: 89 - protein, 398 aa, Streptococcus pyogenes
MNKKKLGVRLLSLLALGGFVLANPVFADQNFARNEKEAKDSAITFIQKSAAIKAGARSAEDIKLDKVNLGGELSGSNMYVYNISTGGFVIVSGDKRSPEILGYSTSGSFDANGKENIASFMESYVEQIKENKKLDTTYAGTAEIKQPVVKSLLDSKGIHYNQGNPYNLLTPVIEKVKPGEQSFVGQHAATGCVATATAQIMKYHNYPNKGLKDYTYTLSSNNPYFNHPKNLFAAISTRQYNWNNILPTYSGRESNVQKMAISELMADVGISVDMDYGPSSGSAGSSRVQRALKENFGYNQSVHQINRGDFSKQDWEAQIDKELSQNQPVYYQGVGKVGGHAFVIDGADGRNFYHVNWGWGGVSDGFFRLDALNPSALGTGGGAGGFNGYQSAVVGIKP

SEQ ID NO: 90 - protein, 511 aa, Streptococcus pyogenes
MSVKALSFTRRIRMINKKISLGVLSILTAFSLQSVSYACTGFIIGKDLTKDGSLLYGRTEDLEPHHNKNFIVRLAKDNPAGEKWKDLSNGFEYPLPEHSYRYSAIPDVTPNKGVYDEAGFNEFGVSMSATVSASANDAIQKIDPYVKNGLAESSMTSVILPSVKTAREGVALIAKIVTEKGAAEGNIVTLADKDGIWYMEILSGHQYVAIKFPDDKYAVFPNTFYLGHVDFNDKENTIASEDVEKVAKKAKSYTEVDGKFHIAKSYNPPLNDANRSRSFSGIKSLDPDSKVTYKDSNYELLQSTDKTFSLEDAMKLQRNRFEGLDLKPLDQMALDGKGKPKSKKAVKGYAYPISNPNVMEAHIFQLKKDIPAELGGVMWLSIGSPRNAPYLPYLGNISRTYEAYQEKSTQYNDKSWYWTVSHINDLVAAHPKPFGTKVIDEMKGLEKTWIAEQDKSTKEISDLVVSDPKAAQEKADKISLDRAEKTFKRLKAIEAKLVKEKPKNKKGLNRS

SEQ ID NO: 91 - protein, 128 aa, Streptococcus pyogenes
VNKRFKTGFLALVAMLLVACSQGTKQIQTTPSVPKADHHVRLVVKEDTNTVDEKVSFGKGDTVLEVLKDNYEVKEKDGFITAIDGIEQDTKANKYWLFKVNGKMADKGADQITVKDGDSIEFYQEVFN

SEQ ID NO: 92 - protein, 113 aa, Streptococcus pyogenes
MTLKKHYYLLSLLALVTVGAAFNTSQSVSAQVYSNEGYHQHLTDEKSHLQYSKDNAQLQLRNILDGYQNDLGRHYSSYYYYNLRTVMGLSSEQDIEKHYEELKNKLHDMYNHY

SEQ ID NO: 93 - protein, 308 aa, Streptococcus pyogenes
MTLLSIIVPCFNEEANILPYFEEMHQLETSMTNQLAFEYIFIDDGSKDNTLGILRELAARFPNVHYLSFSRHFGKEAGLLAGLKEAKGNYITVMDVDLQDPPELLPIMYAKLKEGYDIVGTRRQNRQGEPLIRSMCSNLFYGLIKHLSDTEMVNGVRDYRLMTRQVVDSILELGEVNRFSKGIFSWVGYRITYLSFENQKRKYGKSRWHFWELLRYSLDGFINFSEMPLTIATWTGTFSFLISIFAILFIIIRKILFGDPVSGWASTVSIILFMGGIQLFCMGIIGKYISKIFLETKKRPLYIIKEKH

SEQ ID NO: 94 - protein, 113 aa, Streptococcus pyogenes; identical to SEQ ID NO: 92

SEQ ID NO: 95 - protein, 282 aa, Streptococcus pyogenes
MRRKIKPIVVLVFFILLAMVLIIGKRQANHAKQKEVEDAKSHIPIATSNPGKAKTSTSETEDFILNPIVDVSGWQLPEEIDYDTLSRHISGAIVRVYGGSQITAHNNAAFTTGIDKSFKTHIKEFQKRNVPVAVYSYALGRSTKEMKEEARAFYKNAAPYNPTYYWIDVEEATMKDMNKGVTAFREELKKLGAENVGLYIGTYFMAEQDISTKGFDSVWIPTYGSDSGYYEAAPNTTLDYDLHQYTSQGYLSGFNNALDLNQIAVTKDTKKTFEKLFGNSNN

SEQ ID NO: 96 - protein, 296 aa, Streptococcus pyogenes
MSDKHINLVIVTGMSGAGKTVAIQSFEDLGYFTIDNMPPALVPKFLELIEQTNENRRVALVVDMRSRLFFKEINSTLDSIESNPSIDFRILFLDATDGELVSRYKETRRSHPLAADGRVLDGIRLERELLSPLKSMSQHVVDTTKLTPRQLRKTISDQFSEGSNQASFRIEVMSFGFKYGLPLDADLVFDVRFLPNPYYQVELREKTGLDEDVFNYVMSHPESEVFYKHLLNLIVPILPAYQKEGKSVLTVAIGCTGGQHRSVAFAHCLAESLATDWSVNESHRDQNRRKETVNRS

SEQ ID NO: 97 - protein, 352 aa, Streptococcus pyogenes
MKYQLNSNVRVVTFQDTFCFRKGIWDFNEAILDLTQEPQNLKIVYQEIVSQLVKGVAIDTETYENTLEPETFANLMEVISGLYYNDMLMLEDDYNLEENVMKILMGNFRFMAQAGHMVSNDPVLFISDSTYVNESAELLAEQLHLQLQVASDDLKMLIQQTDVSSRLDALEHRRNMNCLSDALCDYQSIIICQERLNIMMLRHLNEVSVAMKKQLVIGFVDGPFLHTCTLNPPHSADFDSLERRVLARLQDSTLYQHFANQVLPATQDVSQAYLPLLNVLMNLVVSEAFIIAQTGSSKFEGRLLSIYLPTLEIQVQDILKMSNSQTQGALAKLKYEDQQISTREIVKKLLDE

SEQ ID NO: 98 - protein, 910 aa, Streptococcus pyogenes
MINKKCIIPVSLLTLAITLTSVEEVTSRQNLTYANEIVTQRPKRESVISDKSNFPVISPYLASVDFGERKTPLPTPDKGVKVTTEQSIAQVRKGPEERPYTVTGKITSVINGWGGYGFYIQDSEGIGLYVYPQKDLGYSKGDIVQLTGTLTRFKGDLQLQQVTAHKKLELSFPTSVKEAVISELETTTPSTLVKLSHVTVGELSTDQYNNTSFLVRDDSGKSIVVHIDHRTGVKGADVVTKISQGDLINLTAILSIVDGQLQLRPFSLEQLEVVKKVTSSNSDASSRNIVKIGEIQGASHTSPLLKKAVTVEQVVVTYLDDSTHFYVQDLNGDGDLATSDGIRVFAKNAKVQVGDVLTISGEVEEFFGRGYEERKQTDLTITQIVAKAVTKTGTAQVPSPLVLGKDRIAPANIIDNDGLRVFDPEEDAIDYWESMEGMLVAVDDAKILGPMKNKEIYVLPGSSTRPLNNSGGVLLPANSYNTDVIPVLFKKGKQIIKAGDSYKGRLAGPVSYSYGNYKVFVDDSKNMPSLMDGHLKPEKTNLQKDLSKLSIASYNIENFSANPSSTKDEKVKRIAESFIHDLNAPDIIGLIEVQDNNGPTDDGTTDATQSAQRLIDAIKKLGGPTYRYVDIAPENNVDGGQPGGNIRTGFLYQPERVSLSDKPKGGARDALTWVNGELNLSVGRIDPTNAAWKDVRKSLAAEFIFQGRKVVVVANHLNSKRGDNALYGCVQPVTFKSEQRRHVLANMLAQFAKEGAKHQANIVMLGDFNDFEFTKTIQLIEEGDMVNLVSRHDISDRYSYFHQGNNQTLDNILVSRHLLDHYEFDMVHVNSPFMEAHGRASDHDPLLLQLSFSKENDKAESSKQSVKAKKTSKGKLLPKTGDSLVYVITLLGTASLLVPILLLTKGKKES

SEQ ID NO: 99 - protein, 120 aa, Streptococcus pyogenes
MVKELKAFLFRGNIIELAVAVIIGGAFGAIVTSFVNDIITPLILNPALKAANVENITQLSWNGVKYGSFLGAVINFLIIGTSLFFVVKAAEKAMPKKEKEAAAPTQEELLTEIRDLLAQK

SEQ ID NO: 100 - protein, 158 aa, Streptococcus pyogenes
MAKEPWEEKIVDDTIGTRTRKSRNAFISTPWLTALLSVFFVIIVAILFIFFYTSNSGSNRQAETNGFYGASTHKKTRKASNAKKTSSSSTTTDTTPSSEETLASSEGTGETLTVLAGEGAASIAARAGISVEQLQALNPEHMTQGYWYANPGDQVTIK

SEQ ID NO: 101 - protein, 423 aa, Streptococcus pyogenes
MSKRGKIKITTKTKLITASVITLVLIITGIVLWKQQRNTLTADIAKEPYSTVSVTEGSIASSTLLSGTVKALSEEYIYFDANKGNDATVTVKVGDQVTQGQQLVQYNTTTAQSAYDTAVRSLNKIGRQINHLKTYGVPAVSTETNRDEATGEETTTTVQPSAQQNANYKQQLQDLNDAYADAQAEVNKAQIALNDTVVISSVSGTVVEVNNDIDPSSKNSQTLVHVATEGQLQVKGTLTEYDLANVKVGQSVKIKSKVYSNQEWTGKISYVSNYPTESNAGSTTPAGSTGAGSSTGATYDYKIDIISPLNQLKQGFTVSVEVVNEAKQALVPLTAVIKKDKKHYVWTYDDATGKAKKVEVTLGNADAQQQEIHKGVAVGDIVIANPDKNIKPDKKLEGVISIGTNTKPEKDSQSKNKKSGVDK

SEQ ID NO: 102 - protein, 1008 aa, Streptococcus pyogenes
MKKHLKTVALTLTTVSVVTHNQEVFSLVKEPILKQTQASSSISGADYAESSGKSKLKINETSGPVDDTVTDLFSDKRTTPEKIKDNLAKGPREQELKAVTENTESEKQITSGSQLEQSKESLSLNKTVPSTSNWEICDFITKGNTLVGLSKSGVEKLSQTDHLVLPSQAADGTQLIQVASFAFTPDKKTAIAEYTSRAGENGEISQLDVDGKEIINEGEVFNSYLLKKVTIPTGYKHIGQDAFVDNKNIAEVNLPESLETISDYAFAHLALKQIDLPDNLKAIGELAFFDNQITGKLSLPRQLMRLAERAFKSNHIKTIEFRGNSLKVIGEASFQDNDLSQLMLPDGLEKIESEAFTGNPGDDHYNNRVVLWTKSGKNPSGLATENTYVNPDKSLWQESPEIDYTKWLEEDFTYQKNSVTGFSNKGLQKVKRNKNLEIPKQHNGVTITEIGDNAFRNVDFQNKTLRKYDLEEVKLPSTIRKIGAFAFQSNNLKSFEASDDLEEIKEGAFMNNRIETLELKDKLVTIGDAAFHINHIYAIVLPESVQEIGRSAFRQNGANNLIFMGSKVKTLGEMAFLSNRLEHLDLSEQKQLTEIPVQAFSDNALKEVLLPASLKTIREEAFKKNHLKQLEVASALSHIAFNALDDNDGDEQFDNKVVVKTHHNSYALADGEHFIVDPDKLSSTIVDLEKILKLIEGLDYSTLRQTTQTQFRDMTTAGKALLSKSNLRQGEKQKFLQEAQFFLGRVDLDKAIAKAEKALVTKKATKNGQLLERSINKAVLAYNNSAIKKANVKRLEKELDLLTGLVEGKGPLAQATMVQGVYLLKTPLPLPEYYIGLNVYFDKSGKLIYALDMSDTIGEGQKDAYGNPILNVDEDNEGYHALAVATLADYEGLDIKTILNSKLSQLTSIRQVPTAAYHRAGIFQAIQNAAAEAEQLLPKPGTHSEKSSSSESANSKDRGLQSNPKTNRGRHSAILPRTGSKGSFVYGILGYTSVALLSLITAIKKKKY

SEQ ID NO: 103 - protein, 452 aa, Streptococcus pyogenes
MKVISNFQNKKILILGLAKSGEAAAKLLTKLGALVTVNDSKPFDQNPAAQALLEEGIKVICGSHPVELLDENFEYMVKNPGIPYDNPMVKRALAKEIPILTEVELAYFVSEAPIIGITGSNGKTTTTTMIADVLNAGGQSALLSGNIGYPASKVVQKAIAGDTLVMELSSFQLVGVNAFRPHIAVITNLMPTHLDYHGSFEDYVAAKWMIQAQMTESDYLILNANQEISATLAKTTKATVIPFSTQKVVDGAYLKDGILYFKEQAIIAATDLGVPGSHNIENALATIAVAKLSGIADDIIAQCLSHFGGVKHRLQRVGQIKDITFYNDSKSTNILATQKALSGFDNSRLILIAGGLDRGNEFDDLVPDLLGLKQMIILGESAERMKRAANKAEVSYLEARNVAEATELAFKLAQTGDTILLSPANASWDMYPNFEVRGDEFLATFDCLRGDA

SEQ ID NO: 104 - protein, 243 aa, Streptococcus pyogenes
MKKEFTSILFTVSFCGIIALPVEASGPKVPYTQEGITAISNQATVKLISIADIASSLEGQKPITVSFDIDDTLLFTSQYFQYGKEYITPGSFDFLHKQKFWDLVAKRGDQDSIPKEYAKQLIAMHQKRGDKIVFITGRTRGSMYKKGEIDKTAKSLAKDFKLDKPIAINYTGDKAVKPYQYDKTYYIKKNGSQIHYGDSDEDINAAKEAGARPIRILRAPNSTNLPLPKAGGYGEEVLENSAY

SEQ ID NO: 105 - protein, 249 aa, Streptococcus pyogenes
MVKKQKRRKIKSMSWARKLLIAVLLILGLALLFNKPIRNTLIARNSNKYQVTKVSKKQIKKNKEAKSTFDFQAVEPVSTESVLQAQMAAQQLPVIGGIAIPELGINLPIFKGLGNTELIYGAGTMKEEQVMGGENNYSLASHHIFGITGSSQMLFSPLERAQNGMSIYLTDKEKIYEYIIKDVFTVAPERVDVIDDTAGLKEVTLVTCTDIEATERIIVKGELKTEYDFDKAPADVLKAFNHSYNQVST

SEQ ID NO: 106 - protein, 711 aa, Streptococcus pyogenes; identical to SEQ ID NO: 73

SEQ ID NO: 107 - protein, 217 aa, Streptococcus pyogenes
MGKEIKVKCFLRRSAFGLVAVSASVLVGSTVSAVDSPIEQPRIIPNGGTLTNLLGNAPEKLALRNEERAIDELKKQAIEDKEATTAIEAASSDALEALADQTDALQSEEAAVVKADNAASDALEALADQTDALQSEEAEVVQSDNAASDAWEKAATPIALDVKKTKDTKPVVKKEERQNVNTLPTTGEESNPFFTAAALAIMVSTGVLVVSSKCKEN

SEQ ID NO: 108 - protein, 420 aa, Streptococcus pyogenes
LKKLNVILVGLLSILMLSLAIVFINRWKLNEDSQRIVLAEKKKNTSDLVIKAVKHIKKDQKDYYYFSPIKQADDFFVDNLPVSLYKKKNSDKELILVRPKLQSSHLRSVNTLTISKIVYQKKFFHLAKKSEKVISTYHVTDDLKPFQVKDLVSGHLERIQEEVEKKYPDAGFNSDKYNGLKESNSLLSDGFEVKSGNLIFDKKLTIPLTTLFDVINPDFLANSDRAAYDNYRTYKEQHPKKLVALTFDDGPDPTTTPQVLDILAKYQAKGTFFMIGSKVVNNENLTKRVSDAGHEIANHTWDHPNLTNLSVSEIQHQVNMTNQAIEKACGKKPRYLRPPYGATNATVQQSSGLTQMLWTVDTRDWENHSTDGIMTNVKNQLQPGGVVLMHDIHQTTINALPTVMEYLKAEGYECVTVSEL

SEQ ID NO: 109 - protein, 313 aa, Streptococcus pyogenes
MTSKKACLSSIIVLASLTCGNDTVSANHLSATGDKFDDCSTLVEKDVAPKDELEMLAWSSSQTTDDADRDYEDFLDDDSFISQNETDKMFENLTDDRLLNELDELDEENEEDEEDTIEPEQNVIMPSDDELFDLTDAVETRLTVSSAPHLEAELPKPHLRSLSDTALRSGEIRGHLDNKLDALSVTATKLALTMAQKFDLTTHVYSIGESFSEVLAAHYEDRKAESAFSKKKRFHLPIATPDVVIEELRRLVSSIGSSKEDVSVPYSRKLGMAVAKRKIALPQTGERFSYYPVLLGLMILGLTPIMIPKKINN

SEQ ID NO: 110 - protein, 357 aa, Streptococcus pyogenes
MPQTLHVHSRVKDYDILFTDHVLKTLADCLGERKQRKLLFITDQTVYHLYQTLFEEFAQQYNAFVHVCPPGGQSKSLERVSAIYDQLIAENFSKKDMIVTIGGGVVGDLGGFVAATYYRGIPYIQIPTTLLSQVDSSIGGKVGVHFKGLTNMIGSIYPPEAIIISTTFLETLPQREFSCGISEMLKIGFIHDRPLFQQLRDFQKETDKQGLERLIYQSISNKKRIVEQDEFENGLRMSLNFGHTLGHAIESLCHHDFYHHGEAIAIGMVVDAKLAVSKGLLPKEDLDSLLQVFERYQLPTTLERADVSATSLFDVFKTDKKNSEQHIIFILPTETGFTTLAINKDDHQFVEKLDSLL

SEQ ID NO: 111 - protein, 721 aa, Streptococcus pyogenes
MITIKNPKILKWLKYVLSAILSLIILVIIIGGLLFTFYISSAPKLSEAQLKSTNSSLVYDGNNNLIADLGSEKRENVTADSIPINLVNAITSIEDKRFFNHRGVDLYRIFGAAFHNLTSQTTQGGSTLDQQLIKLAYFSTNESDQTLKRKAQEVWLALQMERKYTKQEILTFYINKVYMGNGNYGMLTAAKSYYGKDLKDLSYAQLALLAGIPQAPSQYDPYLHPEAAQNRRNVVLQQMYMEKHLTKAEYETAIATPVAEGLQSLQQRSTYPKYMDNYLKQVIEEVKKETNKDIFTAGLKVYTNIIPDAQQTLYNIYHSGDYVYYPDQDFQVASTIVDVTNGHVIAQLGGRNQDENVSFGTNQAVLTDRDWGSTMKPITAYAPAIESGVYTSTAQSTNDSVYYWPGTTTQLFNWDLRYNGWMTIQAAIMLSRNVPAVRALEAAGLDYARSFLSSLGINYPEMHYSNAISSNNSSSDKKYGASSEKMAAAYAAFANGGIYHKPRYVNKVEFSDGTSKTFDEKGKRAMKETTAYMMTDMLKTVLTYGTGTAAAIPGVAQAGKTGTSNYTDEELAKIGEKYGLYPDYVGTLAPDENFVGFTKRYAMAVWTGYKNRLTPVYGSSLEIASDVYRSMMTYLTNGYSEDWTMPNGLYRSGGFLYLSGTYASNTDYTNSVYNNLYSNNTTTASSQTTSDDTSSSNDTSNSTNTDNNGSHPSTDDKKTTH

SEQ ID NO: 112 - protein, 240 aa, Streptococcus pyogenes
MATMKQYHKGDSMTKSQKEALYWMLSVLTITLIGGSCLIFGSHPQTQDKVAKHSKSAASLLKKAVKAVNDADRLATAAAIQEAQKAVDKLAESSKKKTLQEQLNVAKAKQEQEDAATQAVKAAEETLNQNLKDIAQKAVNDLSNKGKKAALQSRLDAILPAKPIIDEFPRQSGEITDNSYWTPFPGDVSDTYDNSQSPTLDPSSESSASDVTPQPSHPDPIPPQTSSEPSDSGDKQSSKE

SEQ ID NO: 113 - protein, 328 aa, Streptococcus pyogenes
MKHPIRKTLVTLGLLLTLCLPTPVAASSRSWKSWFIEQYFWLKRDKSYYSKQDDPSFQRYLDACREQSDKPYQLDTNLVNGPLVQENLYGMQVYSWNDNGKPDQKTIIYLAGGSYLNNPTTYHINMLKTLSTSLDAKIVLPIYPKAPRYTYNYTMPKLVNLYQHYYHKNQNVFLMGDSAGGGLALGLAHALHNESVPQPKQLVLLSPWLDVTMSHPEIPEYEDADPILSSWGLKRVGELWAYSADNTNHIYVSPKNGPITYLPPITLFTGTREIFYPDIRDYAAKLKAANHNITFITQEGMNHVYPIYPIEEAKTAQYQIIDAINKTP

SEQ ID NO: 114 - protein, 291 aa, Streptococcus pyogenes
MTKVVIKQLLQVIVVFMISLSTMTNLVYADKGQIYGCIIQRNYRHPISGQIEDSGGEHSFDIGQGMVEGTVYSDAMLEVSDAGKIVLTFRMSLADYSGNYQFWIQPGGTGSFQAVDYNITQKGTDTNGTTLDIAISLPTVNSIIRGSMFVEPMGREVVFYLSASELIQKYSGNMLAQLVTETDNSQNQEVKDSQKPVDTKLGESQDESHTGAMITQNKPKANSSNNKSLSDKKILPSKMGLTTSLELKKEDKFRSKKDLSIMIYYFPTFFLMLGGFAVWVWKKRKKNDKTM

SEQ ID NO: 115 - protein, 1165 aa, Streptococcus pyogenes; identical to SEQ ID NO: 7

SEQ ID NO: 116 - protein, 348 aa, Streptococcus pyogenes
MLTSKHHNLNKLVWRYGLTSAAAVLLAFGGGASSVKAEVSSTTMTSSQRESKIKEIEESLKKYPEVSNEKFWERKWYGTYFKEEDFQKELKDFTEKRLKEILDLIGKSGIKGDRGETGPAGPAGPQGKTGERGAQGPKGDRGEQGIQGKAGEKGERGEKGDKGETGERGEKGEAGIQGPQGEAGKDGAPGKDGAPGEKGEKGDRGETGAQGPVGPQGEKGETGAQGPAGPQGEAGKPGEQGPAGPQGEAGQPGEKAPEKSPEGEAGQPGEKAPEKSKEVTPAAEKPADKEANQTPERRNGNMAKTPVANNHRRLPATGEQANPFFTAAAVAVMTTAGVLAVTKRKENN

SEQ ID NO: 117 - protein, 379 aa, Streptococcus pyogenes
MRRAENNKHSRYSIRKLSVGVTSIAIASLFLGKVAYAVDGIPPISLTQKTTATTSENWHHIDKDGLIPLGISLEAAKEEFKKEVEESRLSEAQKETYKQKIKTAPDKDKLLFTYHSEYMTAVKDLPASTESTTQPVEAPVQETQASASDSMVTGDSTSVTTDSPEETPSSESPVAPALSEAPAQPAESEEPSVAASSEETPSPSTPAAPETPEEPAAPSPSPESEEPSVAAPSEETPSPETPEEPAAPSQPAESEESSVAATTSPSPSTPAESETQTPPAVTKDSDKPSSAAEKPAASSLVSEQTVQQPTSKRSSDKKEEQEQSYSPNRSLSRQVRAHESGKYLPSTGEKAQPLFIATMTLMSLFGSLLVTKRQKETKK

SEQ ID NO: 118 - protein, 1181 aa, Streptococcus pyogenes
LRKKQKLPFDKLAIALMSTSILLNAQSDIKANTVTEDTPATEQAVETPQPTAVSEEAPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIIDAVNLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGMKEDDFKDVKGKIALIERGDIDFKDKIANAKKAGAVGVLIYDNQDKGFPIELPNVDQMPAAFISRKDGLLLKENPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKLFALAPKALYETSWQKITIPANSSKQVTIPIDVSQFSKDLLAPMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPETKPEQDGSGQAPDKKPETKPEQDGSGQTPDKKPETKPEQDGSGQTPDKKPETKPEKDSSGQTPGKTPQKGQPSRTLEKRSSKRALATKASTKDQLPTTNDKDTNRLHLLKLVMTTFFLGLVAHIFKTKRTED

SEQ ID NO: 119 - protein, 484 aa, Streptococcus pyogenes
MAKNNTNRHYSLRKLKTGTASVAVALTVLGAGFANQTEVKANGDGNPREVIEDLAANNPAIQNIRLRYENKDLKARLENAMEVAGRDFKRAEELEKAKQALEDQRKDLETKLKELQQDYDLAKESTSWDRQRLEKELEEKKEALELAIDQASRDYHRATALEKELEEKKKALELAIDQASQDYNRANVLEKELETITREQEINRNLLGNAKLELDQLSSEKEQLTIEKAKLEEEKQISDASRQSLRRDLDASREAKKQVEKDLANLTAELDKVKEDKQISDASRQGLRRDLDASREAKKQVEKDLANLTAELDKVKEEKQISDASRQGLRRDLDASREAKKQVEKALEEANSKLAALEKLNKELEESKKLTEKEKAELQAKLEAEAKALKEQLAKQAEELAKLRAGKASDSQTPDTKPGNKAVPGKGQAPQAGTKPNQNKAPMKETKRQLPSTGETANPFFTAAALTVMATAGVAAVVKRKEEN

SEQ ID NO: 120 - protein, 541 aa, Streptococcus pyogenes
MKKRKLLAVTLLSTILLNSAVPLVVADTSLRNSTSSTDQPTTADTDTDDESETPKKDKKSKETASQHDTQKDHKPSHTHPTPPSNDTKQTDQASSEATDKPNKDKNDTKQPDSSDQSTPSPKDQSSQKESQNKDGRPTPSPDQQKDQTPDKTPEKSADKTPEKGPEKATDKTPEPNRDAPKPIQPPLAAAPVFIPWRESDKDLSKLKPSSRSSAAYVRHWTGDSAYTHNLLSRRYGITAEQLDGFLNSLGIHYDKERLNGKRLLEWEKLTGLDVRAIVAIAMAESSLGTQGVAKEKGANMFGYGAFDFNPNNAKKYSDEVAIRHMVEDTIIANKNQTFERQDLKAKKWSLGQLDTLIDGGVYFTDTSGSGQRRADIMTKLDQWIDDHGSTPEIPEHLKITSGTQFSEVPVGYKRSQPQNVLTYKSETYSFGQCTWYAYNRVKELGYQVDRYMGNGGDWQRKPGFVTTHKPKVGYVVSFAPGQAGADATYGHVAVVEQIKEDGSILISESNVMGLGTISYRTFTAEQASLLTYVVGDKLPRP

SEQ ID NO: 121 - protein, 422 aa, Streptococcus pyogenes
MFQLRKKMTRKQLALLSAGVLTCVVGGSYLIMNHQQQEIVSSVNKVKALTIKEAMEQGKDISLTLAGEVTANNSSKVKIDSSKGEVKEVFVKKGDVVKVGQPLFSYETSQRLTAQSSEFDVQTKANQLQVAKTNAALKWETYNRKVNEINTLKSRYNTAPDESLLEQIRSAEDSVSQALSDAKTADSDVKTAQIELDKANATATTEKGKLEYDTVKSDTAGTIVSLNTDLPNQSKSKKENETFMEIIDKSKMLVKGNISEFDRDKLKIGQKVEVIDRKDNSKKWTGKVTQVGNLKAEEKGQGQGQGGNDQQDNPNQAKFPYVIELDQSDKQPLIGSHTYVNVLNNVPEAGKIVLKETFTMAENGKTYVWKVDKNKVKKQEIKTKPFSKGYVEVTSGLTMQDKIAQPLPGMKDGMEVGSIVKP

SEQ ID NO: 122 - protein, 271 aa, Streptococcus pyogenes
MNLLGSRRVFSKKCRLVKFSMVALVSATMAVTTVTLENTALARQTQVSNDVVLNDGASKYLNEALAWTFNDSPNYYKTLGTSQITPALFPKAGDILYSKLDELGRTRTARGTLTYANVEGSYGVRQSFGKNQNPAGWTGNPNHVKYKIEWLNGLSYVGDFWNRSHLIADSLGGDALRVNAVTGTRTQNVGGRDQKGGMRYTEQRAQEWLEANRDGYLYYEAAPIYNADELIPRAVVVSMQSSDNTINEKVLVYNTANGYTINYHNGTPTQK

SEQ ID NO: 123 - protein, 658 aa, Streptococcus pyogenes
MKKFRFETIHLIMMGLILFGLLALCVSIMQSKILILLAIFLVLLFVVALLWYQKEAYQLSDLAHIELLNEQTEDNLKTLLDNMPVGVVQFDQETNAVEWYNPYAELIFTTEEGFIQNGLIQQIITEKRREDISQTFEVSGNKYTSYIDVSSGIFYFFDSFVGNRQLADASMLRPVVGIISVDNYDDITDDLSDADTSKINSFVANFIDEFMESKRIFYRRVNMDRYYFFTDFKTLNDLMDNKFSVLEEFRKEAQDAQRPLTLSIGISFGEENHSQIGQVALENLNIALVRGGDQIVIRENADHTNPIYFGGGSVSTVKRSRTRTRAMMTAISDRIKMVDNVFIVGHRKLDMDALGSAVGMQFFAGNIIENSFAVYNPDEMSPDIERAIERLQADGKTRLISVSQAMGLVTPRSLLVMVDHSKISLTLSKEFYEQFQNVIVVDHHRRDDDFPDNAILTFIESGASSAAELVTELIQFQNAKKCLNKIQASVLMAGIMLDTKNFSTRVTSRTFDVASYLRSKGSDSVEIQNISATDFEEYKQINEIILQGERLGDSIIVAAGEKNHLYSNVIASKAADTILSMAHVEASFVLVETASHKIAISARSRSKINVQRVMEKLGGGGHFNLAACQLTDISLPQAKYLLLKTINMTMKETGEVES

SEQ ID NO: 124 - protein, 407 aa, Streptococcus pyogenes
MPSMKHILKSLSILLIGFLGGLIAIITFNNLYPHSPSKINSGKATTSNMVFNNTTNTTKAVKAVQNAVVSVINYQDNPSSSLSNPYTKLFGEGRSKENKDAELSIFSEGSGVIYRKDGNSAYVVTNNHVIDGAKRIEILMADGSKVVGELVGADTYSDLAVVKISSDKIKTVAEFADSTKLNVGEVAIAIGSPLGTQYANSVTQGIVSSLSRTVTLKNENGETVSTNAIQTDAAINPGNSGGPLINIEGQVIGINSSKISSTPTGSNGNSGAVEGIGFAIPSTDVIKIIKQLETNGEVIRPALGISMVNLNDLSTNALSQINIPTSVTGGIVVAEVKEGMPASGKLAQYDVITEIDGKTVNSISDLQSSLYGHDINDTIKVTFYRGTTKKKADIKLTKTTQDLTKTQ

SEQ ID NO: 125 - protein, 416 aa, Streptococcus pyogenes
MLKRLWLILGPLLIAFVLVVITIFSFPTQLDHSIAQEKANAVAITDSSFKNGLIKRQALSDETCRFVPFFGSSEWSRMDSMHPSVLAERYKRSYRPFLIGKRGSASLSHYYGIQQITNEMQKKKAIFVVSPQWFTAQGINPSAVQMYLSNTQVIEFLLKARTDKESQFAAKRLLELNPGVSKSNLLKKVSKGKSLSRLDRAILKCQHQVALREESLFSFLGKSTNYEKRILPRVKGLPKVFSYKQLNALATKRGQLATTNNRFGIKNTFYRKRIAPKYNLYKNFQVNYSYLASPEYNDFQLLLSEFAKRKTDVLFVITPVNKAWADYTGLNQDKYQAAVRKIKFQLKSQGFHRIADFSKDGGESYFMQDTIHLGWNGWLAFDKKVQPFLETKQPVPNYKMNPYFYSKIWANRKDLQ

SEQ ID NO: 126 - protein, 310 aa, Streptococcus pyogenes
MGKRMSLILGAFLSVFLLVACSSTGTKTAKSDKLKVVATNSIIADMTKAIAGDKIDLHSIVPIGQDPHEYEPLPEDVEKTSNADVIFYNGINLEDGGQAWFTKLVKNAQKTKNKDYFAVSDGIDVIYLEGASEKGKEDPHAWLNLENGIIYSKNIAKQLIAKDPKNKETYEKNLKAYVAKLEKLDKEAKSKFDAIAENKKLIVTSEGCFKYFSKAYGVPSAYIWEINTEEEGTPDQISSLIEKLKVIKPSALFVESSVDRRPMETVSKDSGIPIYSEIFTDSIAKKGKPGDSYYAMMKWNLDKISEGLAK

SEQ ID NO: 127 - protein, 435 aa, Streptococcus pyogenes
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 128 - protein, 199 aa, Streptococcus pyogenes
LKVKKRRRRAKSSVNRLVLGLVLLNLIVSMWTLKLGNQRLAPYADHETLTFVRKISHAAQSVAQKKQLYSSVMMAQAILESNNGKSQLSQKPYYNFFGIKGSYKERSVIFPTLEDDGQGNLYQIDAAFRSYGSLTACFLDYARVLNDPLYDKTHKKFWSHYQDATATLTGTYATDTTYHTKLNELIEWYQLTNFDGLMK

SEQ ID NO: 129 - protein, 235 aa, Streptococcus pyogenes
MTKKKGKLVLISLFVLAACLGAYSAMRQSHKTSNVSAETIASSSTRHFIDEIGPTASTIGQERDLYASVMIAQAILESSNGKSSLSQAPYYNFFGIKGAYNGSSVTMSTWEDDGNGNTYTIDQAFRAYPSIADSLNDYADLLSSSTYIGARKSNTLSYQDATAALTGLYATDTSYNLKLNNIIATYGLTAYDVANSSAQETGLATSGYVWNEYRRNYTDAETLAVDEAWAKRMTY

SEQ ID NO: 130 - protein, 670 aa, Streptococcus pyogenes
MKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 131 - protein, 357 aa, Streptococcus pyogenes
MRKLYSFLAGVLGVIVILTSLSFILQKKSGSGSQSDKLVIYNWGDYIDPALLKKFTKETGIEVQYETFDSNEAMYTKIKQGGTTYDIAVPSDYTIDKMIKENLLNKLDKSKLVGMDNIGKEFLGKSFDPQNDYSLPYFWGTVGIVYNDQLVDKAPMHWEDLWRPEYKNSIMLIDGAREMLGVGLTTFGYSVNSKNLEQLQAAERKLQQLTPNVKAIVADEMKGYMIQGDAAIGITFSGEASEMLDSNEHLHYIVPSEGSNLWFDNLVLPKTMKHEKEAYAFLNFINRPENAAQNAAYIGYATPNKKAKALLPDEIKNDPAFYPTDDIIKKLEVYDNLGSRWLGIYNDLYLQFKMYRK

SEQ ID NO: 132 - protein, 444 aa, Streptococcus pyogenes
MATYQEYKSRSNGNAYDIDGSLGAQCWDGYADYCKYLGLPYANCTNTGYAKDIWEQRHKNGILNYFDEVETMQAGDVAIFMVVAGVTPYSHVAIFDSDAGSGYGWFLGQNQGGANGAYNLVKIPYSTTYPTAFRPKVFKNAVTVIGNIGLNKGDYFIDVSAYQQADLTATCQQAGTTKTIIKVSESLAWLSDRHQQQANTSDPIGYYHFGRFGGDSNLAQREADLFLSNLPTKKVSYLVIDYEDSASADKEANTNAVIAFMDKIANAGYKPVYYSYKPFTLNNIDYQQIIAKYPNSIWIAGYPDYEVRTEPLWEFFPSMDGVRWWQFTSVGVAGGLDKNIVLLADDSSKVDIPKIDKPQSQLTFNQKLDTNTKLDNSNVPYYEATLRTDYYVESKPNASSADKEFIKAGTRVRVYEKVNGWSRINASQSDQWVEDKYLSNATQV

SEQ ID NO: 133 - protein, 225 aa, Streptococcus pyogenes
MSSVGVINLRNLYSTYDPTEVKGKINEGPPFSGSLFYKNIPYGNSSIELKVELNSVEKANFFSGKRVDIFTLEYSPPCNSNIKKNSYGGITLSDGNRIDKKNIPVNIFIDGVQQKYSYTDISTGSTDKKEVTIQELDVKSRYYLQKHFNIYGFGDVKDFGRSSRFQSGFEEGNIIFHLNSGERISYNLFDTGHGDRESMLKKYSDNKTAYSDQLHIDIYLVKFNK

SEQ ID NO: 134 - protein, 550 aa, Streptococcus pyogenes
MSFDGFFLHHLTNELKENLLYGRIQKVNQPFERELVLTIRNHRKNYKLLLSAHPVFGRVQITQADFQNPQVPNTFTMIMRKYLQGAVIEQLEQIDNDRIIEIKVSNKNEIGDAIQATLIIEIMGKHSNIILVDRAENKIIESIKHVGFSQNSYRTILPGSTYIEPPKTAAVNPFTITDVPLFEILQTQELTVKSLQQHFQGLGRDTAKELAELLTTDKLKRFREFFARPTQANLTTASFAPVLFSDSHATFETLSDMLDHFYQDKAERDRINQQASDLIHRVQTELDKNRNKLSKQEAELLATENAELFRQKGELLTTYLSLVPNNQDSVILDNYYTGEKIEIALDKALTPNQNAQRYFKKYQKLKEAVKHLSGLIADTKQSITYFESVDYNLSQASIDDIEDIREELYQAGFLKSRQRDKRHKRKKPEQYLASDGTTILMVGRNNLQNEELTFKMAKKGELWFHAKDIPGSHVIIKDNLDPSDEVKTDAAELAAYYSKARLSNLVQVDMIEAKKLHKPSGAKPGFVTYTGQKTLRVTPDQAKILSMKLS

SEQ ID NO: 135 - protein, 210 aa, Streptococcus pyogenes
MVENTKLLCSWVWLLALAILITIYSTWLWYPLEVDHLKLEQVVFMSKDAILHNYNGLLNYLTNPFVTRLEFANFHSSADGLKHFADVKWLFHLTQVVFLGLLYPTLKTFTQRLKTKRFWLLQKPLILAALFPLMIGLMASFIGFEHFFTLFHQVLFVGDSSWLFDPLKDSVIWILPEVFFLHCFLFFMIVYEIILWSLVGLARWQRLNVE

SEQ ID NO: 136 - protein, 265 aa, Streptococcus pyogenes
MTTMQKTISLLSLALLIGLLGTSGKAISVYAQDQHTDNVIAESTISQVSVEASMRGTEPYIDATVTTDQPVRQPTQATITLKDASDNTINSWVYTMAAQQRRFTAWFDLTGQKSGDYHVTVTVHTQEKAVTGQSGTVHFDQNKARKTPTNMQQKDTSKAMTNSVDVDTKAQTNQSANQEIDSTSNPFRSATNHRSTSLKRSTKNEKLTPTASNSQKNGSNKTKMLVDKEEVKPTSKRGFPWVLLGLVVSLAAGLFIAIQKVSRRK

SEQ ID NO: 137 - protein, 419 aa, Streptococcus pyogenes
MSWNWKKTSVLGTLSLASVLPLTACVSGGGKGVKETDGKTIVVSVDEGYVDYIKSIKGEFEKEHKVTVKVKKEGMMDTLDKLSTDGPTGASPDVFLAPFDRVGGLGTEGQIAEVTLGNSKEFDDTVKKLVTIDGKTYGAPDVIETLVTYYNKDLVPQAPKSFTELEVLQKDSKFAFASEPGKSVGFLAKWTDFYYGYGLIAGYGGYIFGDKGTKPSDLGLGNDGTVEGLNYAKQWYGTWPQGMQDTKKAGDFITEQFISKKAGVIIDGPWAASSFKDAGVNFGVMEIPTLTNGKKYQPFAGGKAWVISNYSKGKTTAQKFLDYVTNAENQKRFYDKTQEIPANLTARNYASKEGNELTKAVISQFESAQPMPNIPEMAEVWEPGANMFFNVASGKEEASKAAKEAAKTIKEAIEQKYAE

SEQ ID NO: 138 - protein, 275 aa, Streptococcus pyogenes
MPKERVDVLAYKQGLFETREQAKRGVMAGLVVSVINGQRYDKPGDKIDDGTELKLKGEKLKYVSRGGLKLEKGLHVFGVSVANQIGIDIGASTGGFTDVMLQDGAKLVYAVDVGTNQLVWKLRQDPRVRSMEQYNFRYAQPEDFNEGQPVFASIDVSFISLSLILPALHNVLSDQGQVIALIKPQFEAGREQIGKKGIVKDKQIHEKVIQKVMDFASGYGFTVKGLDFSPIQGGHGNIEFLAHLAKSQTPETLAPHLIQKVVAKAHKEFEKHEKE

SEQ ID NO: 139 - protein, 439 aa, Streptococcus pyogenes
MAFSFDTASIQGAIIKVIGVGGGGGNAINRMIDEGVAGVEFIAANTDIQALSSSKAETVIQLGPKLTRGLGAGGQPEVGRKAAEESEEILTEALTGADMVFITAGMGGGSGTGAAPVIARIAKSLGALTVAVVTRPFGFEGNKRGNFAIEGIEELREQVDTLLIISNNNLLEIVDKKTPLLEALSEADNVLRQGVQGITDLITSPGLINLDFADVKTVMANKGNALMGIGIGSGEERIVEAARKAIYSPLLETTIDGAQDVIVNVTGGLDMTLTEAEEASEIVGQAAGQGVNIWLGTSIDDTMKDDIRVTVVATGVRQEKAEQVSGFRQPRTFTQTNAQQVAGAQYASDQAKQSVQPGFDRRSNFDFDMGESREIPSAQKVISNHNQNQGSAFGNWDLRRDNISRPTEGELDNHLNMSTFSANDDSDDELETPPFFKNR

SEQ ID NO: 140 - protein, 360 aa, Streptococcus pyogenes
MPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 141 - protein, 1168 aa, Streptococcus pyogenes
MVYRQKSSEIVTRTITKPSRATSNVKQEIDMTPDSKEQTVTGYQYHYIDQEGRKQPFNQGWRFLMADVACAQDPSFDDSNWQVIHLPHDFSLTQPYTRNGEAESAYKLGGVGWYRHYLVLDEVLAGCHVAITFEGSYMETEIYVNGQFIGKHLNGYQEFTYDISDVVTFGAENLLAVRVENKVPSSRWYSGSGLYREVSLSVLPQLHFVADQVAMTLADTAVQEKGQQKVDLRFALNQSIQTCHYQLSLCLWEQSHCSKDKKLLYQETEVPLADLAFQRQYGLTLSLEELQLWSPDNPHLYDLELTLYYQGQVIDCFCLETGFRQLTFMANQGLFVNGRAVKLKGVCLHHDQGGLGACAYEDALARQLVLLKDMGANTIRSTHNPSSPKLRQLANRLGFFVIEEAFDTWTYAKNGNVNDFSNYFHQTIGTENANYLQRVRSPETSWAQYSIEAMVWSAKNDPSVLMWSIGNELMEGFSADVSHYPELTRQMCQWITAIDTSRPITFGDNKLKEADFCWHEEVSQMATLLSQLDHPQGLIGLNYADGKDYDRLHEEHSDWLLYGSETVSAITSRAYYKETKKVLDSGYHLTSYDHAKVDWGAFASQAWYDTITRDFVAGECVWTGFDYLGEPTPWNKIDSGVVGLWPSPKNAYFGILDTAGFPKDSYYFYQSQWAQGQTTLHLLPVWQKDQLCFDEQGLVEVVVYSNAASVQLMFEDEQGNLTDYGRKAFHTYSTPTGHTYQLYQGADAAKNPHENLYLTWRVPYQKGLLRAVAYDISGKSIPKTSGRSQVRTYGSVAKLSWKAFEAPIDAPWELLYLDLSLLDSRGELVSHAQDWLQVQVEGPARLLALDNGNPTDHTPYQEPLRQAYGGKLLAILALTGEAGHIKVTAKASQQLSSVFQTQVACRAPKEHLVTLPLEKYQFKKSRLTSQQEIGQSCLKTTQFLSVLENKDTQQKAGKASTPHILITSYQHYLSLPLQVCSQAFDFKKGDDIFLPQWLQVKDAQGSLVKKAFSMTWYLKEKIFAKPILVTGYVSCFGQSIPVEARLNLAQASKRRHQDLSLVAKQSLAASQKRLTYCYQYDTVQAIGAISLQNHTGTSLSVSVAISYGSQSSIKQETLMLADSHLSQLEEVIFFDDILTVLYLAVTLEVIEGPDLTEDSIQIGLWDLA

SEQ ID NO: 142 - protein, 489 aa, Streptococcus pyogenes
VSEESKEVEVTKESQTLGLNEAKSMTIGEAVRKQSEIKAGVTKDDSILDKYIKQHRDEVSSQKFDAKYTELDTASLDNFIKKQREALSKAGLVDDEPVSAESAEQDSTLVEEVAEDLAPMETTAVVTGIPVEATVPVLDLDPSERVIPEPQMTKEEPKRDQFLSEDSHHPAKQNTKKGWLIALFLLLLAILAVVFGWNHFLRQDSGKTTQTASKQTKTSLQTDSAKKATRLKAAAKAFEKLYGTFYTDATKSKLKNSAFATLPDLEAALKALEGSAYYDKAKAKVDSLKKAIAAITAVNGKFVSDVVVDGEKVSAEVKADANFDDLSSATLTIGNANLDAVLQASITEGRQQLASKAEAAKAANEQAVQDQAAQGQSTSVAPSGYGLTSYDPASLQRHLSRVPYNQDVIADRANPSWAFNPGVLEKIVATSQARGYISGNQYILEPVNIINGNGYYNMFKPDGTYLFSINCKTGYFVGNGKGYADALDY

SEQ ID NO: 143 - protein, 150 aa, Streptococcus pyogenes
MILQSDHTFLYCIVKILGKTMCLSYNRRNQRKKVVLMTIKKFSLLAIASLSLLSLAACDMDDKDDHMDNQPKTSQTSKKVKLSEDKAKSIALKDASVTEADAQMLSVTQDNEDGKAVYEIEFQNKDQEYSYTIDANSGDIVEKSSEPIND

SEQ ID NO: 144 - protein, 1275 aa, Streptococcus pyogenes
MKKISKCAFVAISALVLIQATQTVKSQEPLVQSQLVTTVALTQDNRLLVEEIGPYASQSAGKEYYKHIEKIIVDNDVYEKSLEGERTFDINYQGIKINADLIKDGKHELTIVNKKDGDILITFIKKGDKVTFISAQKLGTTDHQDSLKKDVLSDKTVPQNQGTQKVVKSGKNTANLSLITKLSQEDGAILFPEIDRYSDNKQIKALTQQITKVTVNGTVYKDLISDSVKDTNGWVSNMTGLHLGTKAFKDGENTIVISSKGFEDVTITVTKKDGQIHFVSAKQKQHVTAEDRQSTKLDVTTLEKAIKEADAIIAKESNKDAVKDLAEKLQVIKDSYKEIKDSKLLADTHRLLKDTIESYQAGEVSINNLTEGTYTLNFKANKENSEESSMLQGAFDKRAKLVVKADGTMEISMLNTALGQFLIDFSIESKGTYPAAVRKQVGQKDINGSYIRSEFTMPIDDLDKLHKGAVLVSAMGGQESDLNHYDKYTKLDMTFSKTVTKGWSGYQVETDDKEKGVGTERLEKVLVKLGKDLDGDGKLSKTELEQIRGELRLDHYELTDISLLKHAKNITELHLDGNQITEIPKELFSQMKQLRFLNLRSNHLTYLDKDTFKSNAQLRELYLSSNFIHSLEGGLFQSLHHLEQLDLSKNRIGRLCDNPFEGLSRLTSLGFAENSLEEIPEKALEPLTSLNFIDLSQNNLALLPKTIEKLRALSTIVASRNHITRIDNISFKNLPKLSVLDLSTNEISNLPNGIFKQNNQLTKLDFFNNLLTQVEESVFPDVETLNLDVKFNQIKSVSPKVRALIGQHKLTPQKHIAKLEASLDGEKIKYHQAFSLLDLYYWEQKTNSAIDKELVSVEEYQQLLQEKGSDTVSLLNDMQVDWSIVIQLQKKASNGQYVTVDEKLLSNDPKDDLTGEFSLKDPGTYRIRKALITKKFATQKEHIYLTSNDILVAKGPHSHQKDLVENGLRALNQKQLRDGIYYLNASMLKTDLASESMSNKAINHRVTLVVKKGVSYLEVEFRGIKVGKMLGYLGELSYFVDGYQRDLAGKPVGRTKKAEVVSYFTDVTGLPLADRYGKNYPKVLRMKLIEQAKKDGLVPLQVFVPIMDAISKGSGLQTVFMRLDWASLTTEKAKVVKETNNPQENSHLTSTDQLKGPQNRQQEKTPTSPPSAATGIANLTDLLAKKATGQSTQETSKTDDTDKAEKLKQLVRDHQTSIEGKTAKDTKTKKSDKKHRSNQQSNGEESSSRYHLIAGLSSFMIVALGFIIGRKTLFK

SEQ ID NO: 145 - protein, 316 aa, Streptococcus pyogenes
MVYEMTLAVIKCIENHLHKKVYKGASLALFQSGRWQEYHIGTIDGRRPVDANLVYDLASVSKVVGVATICNILLNNGTLALDDPLKVYYPSIADATVTIRQLLTHTSGLDPYIPNRDVLNAQQLRKALNHLTQKENKNFYYTDVNFLLLGFMLEELFSESLDQIFDKTIFTPFGMYHTSFGPRPEAVPTLKGVSDGEVHDPKAKILKKHSGSAGLFSTLADLESFSNHYLNDPFSDCLWRNYSQQTIERSLGWNLDGDWISHTGYTGPFLMLNKKEQTAAIFLTNRTYDEDDKSKWLKERQLLYNALKHDLTTPVS

SEQ ID NO: 146 - protein, 265 aa, Streptococcus pyogenes; identical to SEQ ID NO: 136

SEQ ID NO: 147 - protein, 134 aa, Streptococcus pyogenes
MTGQKKLANLKKTDKKQIIVRKTVDASVKLKVSKQKEHFIMKFKKVLVIPALALAATCFLTACGTKKDSKKEEVKEIKMSDIKDDAVSKKTKVVDGEEVTEYTTKDGNVIQIPAGNEEGMESKDAGGSGAPAKN

SEQ ID NO: 148 - protein, 778 aa, Streptococcus pyogenes
MRFLELLQKKFFPKAYQEKQFLMHQKTRLTPQHNQKQYSPNANHLDSSATKNSEQDPATALQRSRAYEGSPKSRPAWLQKLEAVLPSPQRPIRRFWRRYHIGKLLMILIGTLVLLLGSYLFYLSKTAKVSDLQDALKATTVIYDHKGEYAGSLSGQKGSYVELNAISDDLENAVIATEDRTFYSNSGINLKRFLLAVVTAGRFGGGSTITQQLAKNAYLSQDQTIKRKAREFFLALELTKKYSKKDILTMYLNNSYFGNGVWGVEDASQKYFGTTAANLTLDEAATLAGMLKGPEIYNPYHSLKNATHRRDTVLGAMVDAKKITQTKAQQARAVGLKNRLADTYVGKTDDYKYPSYFDAVISEAIATYGLSEKDIVNNGYKVYTELDQNYQTGMQTTFNNDELFPVSAYDGSSAQAASVALDPKTGGVRGLIGRVNSSENPTFRSFNYATQAKRSPASTIKPLVVYAPAVASGWSIEKELPNTVQDFDGYQPHNYGNYESEDVPMYQALANSYNIPAVSTLNDIGIDKAFTYGKTFGLDMSSAKKELGVALGGSVTTNPLEMAQAYAAFANNGVIHPAHLINRIENARGEVLKTFTDKAKRVVSQSVADKMTAMMLGTFSNGTAVNANVYGYTLAGKTGTTETNFNPDLAGDQWVIGYTPDVVISQWVGFNQTDENHYLTDSSAGTASAIFSTQASYILPYTKGSQFHVDNAYAQNGISAVYGVNETGNQSGVDTQSIIDGLRKSAQEASQSLSKAVDQSGLRDKAQSIWKEIVDYFR

SEQ ID NO: 149 - protein, 574 aa, Streptococcus pyogenes
MNYLGFFENPLAIYDIIVKKNIESWGLLMTKPFHHKKLKQITIIAATSLFLFLIGGAFYYSKNHCINAYLKARSAQSGPVFENIKAYLVWDDTNEQITNDEAMYTKFRRYSQKELRQKKQDLKAASQDSAVQVKSVGRRFWIFPDYRIAIKPMDLTIKTNVPQADVLLNQKKVAVSDSEQFSVKLDRLPTAEYTASIRGKHNGRNIKVNKSYDGDNPVLDLSVSFRTFLVTSNAKQGDLYFDDNHIGTLKDGQLQVEDYPVTENAQAYMKTTFPDGELRSQKYALADVEEGATLEILVTDLLEEDKAGELLVSAFDQLMHYLSTGQDSSNLRSVFEAGSSNAFYRGLKESIKAKFQTDTRKASRLNIPSILLTTMTQVGKTTYVLDFTATYEFLYDKSTDPEQHTSGHINQDLTGKVTVKKVGQHYLISQSGSKNITVVKEDNQLKAPSVFPESILGTWTGQANGLSIHMSLASDGTITTKVEDQKGNRSKETRTAKISKVEDKGNGFYLYTPDPGSDISALVPEGGLGGANVKYAYGFKISGKTASPVVWQAALTHEFDYTKPLSGVTLQKQP

SEQ ID NO: 150 - protein, 184 aa, Streptococcus pyogenes
MKWSGFMKTKSKRFLNLATLCLALLGTTLLMAHPVQAEVISKRDYMTRFGLGDLEDDSANYPSNLEARYKGYLEGYEKGLKGDDIPERPKIQVPEDVQPSDHGDYRDGYEEGFGEGQHKRDPLETEAEDDSQGGRQEGRQGHQEGADSSDLNVEESDGLSVIDEVVGVIYQAFSTIWTYLSGLF

SEQ ID NO: 151 - protein, 233 aa, Streptococcus pyogenes; identical to SEQ ID NO: 12

SEQ ID NO: 152 - protein, 814 aa, Streptococcus pyogenes
MIMYSTKMQDIFRQAQFQAARFDSHCLETWHVLLAMVAVDNSLANMILSEYDAQVAIEEYEAAAILAMGKTPKEQLSRVDFRPQSKTLTNLLAFAQAISQITRDQEVGSEHVLFAILLNPDIMASRLLEIAGYQIKDNGNGQPRLADLRKAIERHAGYSKEMIKAIHELRKPKKTKTQGTFSDMMKPPSTAGELSDFTRDLTEMARQGLLESVIGRDQEVSRMIQVLSRKTKNNPVLVGDAGVGKTALAYGLAQRIANGAIPYELKEMRVLELDMMSVVAGTRFRGDFEERMNQIIDDIEADGQIILFVDELHTIMGSGSGIDSTLDAANILKPALSRGTLHMVGATTQEEYQKHIEKDAALSRRFAKILIEEPNTEDAYQILMGLKLSYETYHNVSISNEAVKTAVKMAHRYLTSKNLPDSAIDLLDEASAAVQNMVKKSAPETLTPIDQALINGDMKKVSRLLAKEAKGQMRKPTPVTEDDILATLSKLSGIPLEKLTQADSKKYLNLEKELHKRVIGQDAAVTAISRAIRRNQSGIRTGKRPIGSFMFLGPTGVGKTELAKALAEVLFDDEAALIRFDMSEYMEKFAASRLNGAPPGYVGYDEGGELTQKVRNKPYSVLLFDEVEKAHPDIFNVLLQVLDDGILTDSRGRKVDFSNTIIIMTSNLGATALRDDKTVGFGVKDIHQDHQAMEKRILEELRKTYRPEFINRIDEKVVFHSLTQDNMRDVVKIMVQPLITTLAEKGITLKIQPLALKHLSEVGYDEHMGARPLRRTLQTEIEDKLSELILSRELTSGHTLKIGLSHGKLTFHIA

SEQ ID NO: 153 - protein, 448 aa, Streptococcus pyogenes
MSQSTATYINVIGAGLAGSEAAYQIAKRGIPVKLYEMRGVKATPQHKTTNFAELVCSNSFRGDSLTNAVGLLKEEMRRLDSIIMRNGEANRVPAGGAMAVDREGYAESVTAELENHPLIEVIRGEITEIPDDAITVIATGPLTSDALAEKIHALNGGDGFYFYDAAAPIIDKSTIDMSKVYLKSRYDKGEAAYLNCPMTKEEFMAFHEALTTAEEAPLNAFEKEKYFEGCMPIEVMAKRGIKTMLYGPMKPVGLEYPDDYTGPRDGEFKTPYAVVQLRQDNAAGSLYNIVGFQTHLKWGEQKRVFQMIPGLENAEFVRYGVMHRNSYMDSPNLLTETFQSRSNPNLFFAGQMTGVEGYVESAASGLVAGINAARLFKREEALIFPQTTAIGSLPHYVTHADSKHFQPMNVNFGIIKELEGPRIRDKKERYEAIASRALADLDTCLASL

SEQ ID NO: 154 - protein, 295 aa, Streptococcus pyogenes
MERLRRTMMFVPGANAAMLRDAPLFGADSIMFDLEDSVSLKEKDTSRALVHFALKTFDYSSVETVVRVNGLDSCGALDIEAVVLAGVNVIRLPKTETAQDIIDVEAVIERVERENSIEVGRTRMMAAIESAEGVLNAREIAKASKRLIGIALGAEDYVTNMKTRRYPDGQELFFARSMILHAARAAGIAAIDTVYSDVNNTEGFQNEVRMIKQLGFDGKSVINPRQIPLVNEIYTPTKKEIDHAKQVIWAIREAESKGSGVISLNGKMVDKPIVERAERVIALATAAGVLSEEDI

SEQ ID NO: 155 - protein, 254 aa, Streptococcus pyogenes
MAQRIIVITGASGGLAQAIVKQLPKEDSLILLGRNKERLEHCYQHIDNKECLELDITNPVAIEKMVAQIYQRYGRIDVLINNAGYGAFKGFEEFSAQEIADMFQVNTLASIHFACLIGQKMAEQGQGHLINIVSMAGLIASAKSSIYSATKFALIGFSNALRLELADKGVYVTTVNPGPIATKFFDQADPSGHYLESVGKFTLQPNQVAKRLVSIIGKNKRELNLPFSLAVTHQFYTLFPKLSDYLARKVFNYK

SEQ ID NO: 156 - protein, 361 aa, Streptococcus pyogenes
MTKLDQIRLYLDQKGAELAIFSDPVTINYLTGFFCDPHERQLFLFVYHDLAPVLFVPALEVARASQAISFPVFGYVDSENPWEKIKAVLPNTAAKTIYAEFDHLNVNKFHGLQTIFSGQFNNLTPYVQGMRLVKSADEINKMMIAGQFADKAVQVGFDNISLDATETDVIAQIEFEMKKQGIHKMSFDTMVLTGNNAANPHGIPGTNNIENNALLLFDLGVETLGYTSDMTRTVAVGQPDQFKIDIYNLCLEAQLAAIDFIKPGVTAAQVDAAARQVIEKAGYGEYFNHRLGHGIGMDVHEFPSIMAGNDLVLEEGMCFSVEPGIYIPGKVGVRIEDCGHVTKNGFEVFTHTPKELLYFEG

SEQ ID NO: 157 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 158 - protein, 497 aa, Streptococcus pyogenes
MIEKYLESSIESKCQLIVLFFKTSYLPITEVAEKTGLTFLQLNHYCEELNAFFPGSLSMTIQKRMISCQFTHPFKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNTIHSFLSHSSTHLKTSPWLSESFSFYDILLALSWKRHQFSVTIPQTRIFQQLKKLFVYDSLKKSSHDIIETYCQLNFSAGDLDYLYLIYITANNSFASLQWTPEHIRQYCQLFEENDTFRLLLNPIITLLPNLKEQKASLVKALMFFSKSFLFNLQHFIPETNLFVSPYYKGNQKLYTSLKLIVEEWMAKLPGKRDLNHKHFHLFCHYVEQSLRNIQPPLVVVFVASNFINAHLLTDSFPRYFSDKSIDFHSYYLLQDNVYQIPDLKPDLVITHSQLIPFVHHELTKGIAVAEISFDESILSIQELMYQVKEEKFQADLTKQLT

SEQ ID NO: 159 - protein, 995 aa, Streptococcus pyogenes
MDKHLLVKRTLGCVCAATLMGAALATHHDSLNTVKAEEKTVQVQKGLPSIDSLHYLSENSKKEFKEELSKAGQESQKVKEILAKAQQADKQAQELAKMKIPEKIPMKPLHGSLYGGYFRTWHDKTSDPTEKDKVNSMGELPKEVDLAFIFHDWTKDYSLFWKELATKHVPKLNKQGTRVIRTIPWRFLAGGDNSGIAEDTSKYPNTPEGNKALAKAIVDEYVYKYNLDGLDVDVEHDSIPKVDKKEDTAGVERSIQVFEEIGKLIGPKGVDKSRLFIMDSTYMADKNPLIERGAPYINLLLVQVYGSQGEKGGWEPVSNRPEKTMEERWQGYSKYIRPEQYMIGFSFYEENAQEGNLWYDINSRKDEDKANGINTDITGTRAERYARWQPKTGGVKGGIFSYAIDRDGVAHQPKKYAKQKEFKDATDNIFHSDYSVSKALKTVMLKDKSYDLIDEKDFPDKALREAVMAQVGTRKGDLERFNGTLRLDNPAIQSLEGLNKFKKLAQLDLIGLSRITKLDRSVLPANMKPGKDTLETVLETYKKDNKEEPATIPPVSLKVSGLTGLKELDLSGFDRETLAGLDAATLTSLEKVDISGNKLDLAPGTENRQIFDTMLSTISNHVGSNEQTVKFDKQKPTGHYPDTYGKTSLRLPVANEKVDLQSQLLFGTVTNQGTLINSEADYKAYQNHKIAGRSFVDSNYHYNNFKVSYENYTVKVTDSTLGTTTDKTLATDKEETYKVDFFSPADKTKAVHTAKVIVGDEKTMMVNLAEGATVIGGSADPVNARKVFDGQLGSETDNISLGWDSKQSIIFKLKEDGLIKHWRFFNDSARNPETTNKPIQEASLQIFNIKDYNLDNLLENPNKFDDEKYWITVDTYSAQGERATAFSNTLNNITSKYWRVVFDTKGDRYSSPVVPELQILGYPLPNADTIMKTVTTAKELSQQKDKFSQKMLDELKIKEMALETSLNSKIFDVTAINANAGVLKDCIEKRQLLKK

SEQ ID NO: 160 - protein, 197 aa, Streptococcus pyogenes
MKQFIKEWGPFTLFLILFGLSRLFLWQAVKVDGHSMDPTLAHGERLIVFNQARIDRFDIVVAQEEENGQKKEIVKRVIGLPGDTISYNDDTLYINGKKTVEPYLAEYLKQFKNDKLQKTYAYNTLFQQLAETSDAFTTNSEGQTRFEMSVPKGEYLLLGDDRIVSRDSREVGSFKKENLIGEVKARFWPLNKMTVFN

SEQ ID NO: 161 - protein, 88 aa, Streptococcus pyogenes
MNKRIKKKRKLERAIVMLVAENAMQAEAIKNQNKEIMELKSIVQRNALATNEEFASVKAATLDNQSAIADIAIDVNYIKKNYKRKWGK

SEQ ID NO: 162 - protein, 232 aa, Streptococcus pyogenes
MKTLAFDTSNKTLSLAILDDETLLADMTLNIQKKHSVSLMPAIDFLMTCTDLKPQDLERIVVAKGPGSYTGLRVAVATAKTLAYSLNIALVGISSLYALAASTCKQYPNTLVVPLIDARRQNAYVGYYRQGKSVMPQAHASLEVIIEQLVEEGQLIFVGETAPFAEKIQKKLPQAILLPTLPSAYECGLLGQSLAPENVDAFVPQYLKRVEAEENWLKDNEIKDDSHYVKRI

SEQ ID NO: 163 - protein, 278 aa, Streptococcus pyogenes
MTQMNYTGKVKRVAIIANGKYQSKRVASKLFSVFKDDPDFYLSKKNPDIVISIGGDGMLLSAFHMYEKELDKVRFVGIHTGHLGFYTDYRDFEVDKLIDNLRKDKGEQISYPILKVAITLDDGRVVKARALNEATVKRIEKTMVADVIINHVKFESFRGDGISVSTPTGSTAYNKSLGGAVLHPTIEALQLTEISSLNNRVFRTLGSSIIIPKKDKIELVPKRLGIYTISIDNKTYQLKNVTKVEYFIDDEKIHFVSSPSHTSFWERVKDAFIGEIDS

SEQ ID NO: 164 - protein, 378 aa, Streptococcus pyogenes
MAKKLKKNEEITKKFGDERRKALDDALKNIEKDFGKGAVMRLGERAEQKVQVMSSGSLALDIALGAGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYASVRLDVRGTTQIKGTGDQKDSSIGKETKIKVVKNKVAPPFKVAEVEIMYGEGISRTGELVKIASDLDIIQKAGAWFSYNGEKIGQGSENAKRYLADHPELFDEIDLKVRVKFGLLEESEEESAMAVASEETDDLALDLDNGIEIED

SEQ ID NO: 165 - protein, 332 aa, Streptococcus pyogenes
MSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 166 - protein, 587 aa, Streptococcus pyogenes
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVSQMNGLENLNLEMDRNRIKVNDYQETSIPGIYAPGDVNGTKMLAHAAYRMGEVAAENAMHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 167 - protein, 591 aa, Streptococcus pyogenes
MRIKWFSFVRVTGLLLVLLYHFFKNVFPGGFIGVDIFFTFSGYLITALLIDEYTKKESIDIIGFLKRRFYRIVPPLVLMILLTIPFTFLIKKDFIANIGSQITAVLGFTTNIYEILTGSSYESQFIPHLFVHTWSLAIEVHFYLFWGVFVWLLARRKETQKQLRGLLFLISLGIFAISFLSMFIRSFMTSNFSLIYFSSLSHSFPFFLGAMFATITGINETTVRFQKNVRLWPRQYVLAAMIGAFTLLLVLTVTLDFNHITTYLFGFALASLFASIMIYAARVLHEQTPDVQEPKAITYIADISYGIYLFHWPFYIIFSQLMSHILAVILTVFFSILFATVSYYIVEPLVQGRKPNLLGLEIDCSPYYKWIVGGSLALALLTLGTCMIAPKVGKFEKQLLVSSLQQAQSNMERTHTLAAGDANALSDVGIIGDSVALRSSAAFSQIMPQAQLDAAVSRNFKEAFDLFNNQIKSKSLSKTVVLAVGVNSLDNYSQAVQSFIEALPKGHRLVLVSPYNAKNASQVAEARDYGLKLSKKYKYVTIADWYKVAVEHPDIWYGSDGVHYSEDSQGAELYVSTIQTAVEKSAKKPAK

SEQ ID NO: 168 - protein, 666 aa, Streptococcus pyogenes
MAISQMKKLAMVFEKDYLDLVLKTLQQSQLVEVRDMKQLKHWQDAFNKGNVKLPQIVQYDLTHQKPLLDDEALQYLLQSQQELENGLASLSAFLPPIGKLTALRQKTPSLSFKQFEERHRQQAAQTALKMMSQKIERLEQLQSKIDQLTEYCQELEKWRSLTVLPQDLAQFHFLSARVGTIPSTANNHFYHQLKQHKGLFIEEVYHTEFEYGLVLFWQAQDTIHLQKYQFKPLLYKEQLLPSEQLRINKELLTNWLAEKDSLLKELRQSQKILAQLQVEIDYVLSQYQRQQTKKQLLGTRHLIALEGWIEADSVNQLKGLMTKTLGDMFYLDSYDVTPDDWEDVPIKLRNHRYIAPFELVTEMYALPKYQEKDPTPFLAPLYLTFFGMMVADLGYGLLLYAVTLAALVFFNLQKTSKRLVTFFNILAISVAIWGLIYGSFFGFDLPVALLSTKTDVITILVVSLLFGFVTLIFGLLLGAWQQVRMKAYATAYTSSLAWTFILLGLLLFILGKNVSGLAYLSVIGKWLALGNAFGILVVSLLKSKSLLGLGSGLYNLYGISSYLSDLVSFTRLMALGLSGASIGAAFNMIVGIFPPVTRFTVGIFIFILLHAINIFLSMLSGYVHGARLIFVEFFGKFYEGGGKAFNPLKLADNYVNVNEETDLEDN

SEQ ID NO: 169 - protein, 575 aa, Streptococcus pyogenes
LETILQTKLPVAQLVEQLTEWLTKTFSGLFDIMQVVGSFLMDWMTKTLLFIHPLLFIVLVTAGMFFLAKKKWPLPTFTLLGLLFIYNQGLWKQLMNTFTLVLVASLISVLIGIPLGIWMAKNATVRQIVNPILDFMQTMPAFVYLIPAVAFFGIGMVPGVFASVIFALPPTVRFTNLAIRDIPTELIEASDAFGSTGKQKLFKVELPLAKNTIMAGVNQTMMLALSMVVTGSMIGAPGLGREVLSALQHADIGSGFVSGLALVILAIVLDRMTQLFNSKPQEKAKAGKTNKWIGLAALAVFLIAALGRGIMAMTSGMADKGETVNIAYVQWDSEVASTHVIAEVLKNEGYHVTLTPLDNAVMWQTVANGNADFSTSAWLPVTHGQQYQKYKSKLDDLGPNLKGTKLGLAVPKYMTDVNSIEDLSKQADQKITGIEPGAGIMAAAQKTLKEYHNLSSWELVAASTGAMTTSLDQAIKKKDPIVVTAWSPHWMFAKYDLKYLKDPKEIFGSTENINTIARKGLKKELPNVYKIIDKFHWTQKDMEAVMLDINKGMSPEAAAKKWVEANKSKVSSWTK

SEQ ID NO: 170 - protein, 436 aa, Streptococcus pyogenes
MIHLIIISAIALAIGIGYRTKINIGLLAIAFSYLIATTLMGLSPKELLHFWPTSLFFTIFSVSLFYNVATTNGTLDVLAQHILYRTRTHPNALYMILYLIATLLSALGAGFFTTMAVCCPLAITLCQKADKHPLIGAQAVNWGASGGANLITSGSGIVFQGLFKQMGWEEQAFSLGNHIFIVSIIYPLIVLLLLSCYIRYSKGRTNSSLTIDQPPVLSKVQRQTTLLMISSMVLVWLFPLLLLIFPNIAWIATYRQTFDIGFVSILMVCLALRLKLGKQEAILAKVPWAIIIMLCGMSLLMSLAVKSGLVTLIGHLITTTIPHFWLPLFFCVIAGVMSLFSSTLSVVAPTLFPIIATISAQSPHIDIRLLTTATIIGALSTNISPFSSAGSLIQLSLPHIEERSLAFKKQILLGVPISLSLALLTIWILMLLASLS

SEQ ID NO: 171 - protein, 233 aa, Streptococcus pyogenes
MILLFRRFILDDTVIKTISYYYFPFRVNRLNFYSNASGIWTFSNWCSSYLSSWRYVWITSKSNARPVVAIGDSDIYSYRLWSFFCQWINTIFCWSNRRRPLGLTPFLLLYVLSGVMGNAFTFWLTPETVAAGASTSLFGLFAAIVVLSFLGKNQALKDLGKSYQTLIVVNLLMNLFMPNVSMAGHIGGVVGGALLSIVFPTKMRVITVKKTKRMLALVSYGIILVGVLVLGFL

SEQ ID NO: 172 - protein, 528 aa, Streptococcus pyogenes
LKQETYMKKLILSCLVALALLFGGMSRAQANQYLRVGMEAAYAPFNWTQDDASNGAVPIEGTSQYANGYDVQVAKKVAKAMNKELLVVKTSWTGLIPALTSGKIDMIAAGMSPTKERRNEISFSNSSYTSQPVLVVTANGKYADATSLKDFSGAKVTAQQGVWHVNLLTQLKGAKLQTPMGDFSQMRQALTSGVIDAYISERPEAMTAEAADSRLKMITLKKGFAVAESDAAIAVGMKKNDDRMATVNQVLEGFSQTDRMALMDDMVTKQPVEKKAEDAKASFLGQMWAIFKGNWKQFLRGTGMTLLISMVGTITGLFIGLLIGIFRTAPKAKHKVAALGQKLFGWLLTIYIEIFRGTPMIVQSMVIYYGTAQAFGISIDRTLAAIFIVSINTGAYMSEIVRGGIFAVDKGQFKAATALGFTHGQTMRKIVLPQVVRNILPATGNEFVINIKDTSVLNVISVVELYFSGNTVATQTYQYFQTFTIIAIIYFVLTFTVTRILRYIERRFDADTYTTGANQMQIAEVSNV

SEQ ID NO: 173 - protein, 632 aa, Streptococcus pyogenes
MKKILMTLVLCFSLLGIRIKAADVDYSITNYEGQLLLSKENTARFEQKVTYQFDTSYNGQYISLGRTGHLPAGFAIDQKPKVEVYQNGQQVPVSQEFSDLGDGYRLKLYNAGQAGDKVDVKVIWQLHHLLTAYQDVAELNWTPISDWDKTLEKVSLTVTTPTDIQDSNLWAHRGYYQKKPQVLKEGNSRYQINAKNVSGQLELHAYWDKKALLGKEPVDVSTSKKNKIVALETKISRRRTLLQLLFGKVIPLVEVGFLLWQLIQFTRLKKQFNRYHLANHTDHSYEVPEDLSPLVLTQAIYGQSFAYLSPTASESQKLLIPKGVTFEALVQATLLDLIDQKVLLLTKEEGKAYLEISQLDRVTDEEAAFLDMAFGNKVTLPVDQLFSQYHYDADTIKQLKKTYKGKKLEQEVRQSSEQVIKAMKKASAAITNNVLETIKKLNLPDTYRQMTPAEKRKSNSVQGLGCLLLILNSGLLIYLAIKESGLALIYLALMVLTMCLGFYISLKLDQYKKLGIETPEGGVRLHQWQSFKNMIRDIDKFEDVAIEGLVVWNRVLVYATLFGYAKKVERYLKVHRIALPEVYQAVRPGELSMVMYATTPTFVSSLSSATTSSNFSVSSGGGISGGGGGGAF

SEQ ID NO: 174 - protein, 504 aa, Streptococcus pyogenes
LRTTMKKYILNRIMRSLVSVVLVTALTYTIVYTLVPTSLIFKQDPNYNKMTTTPDKKVAYENLTFQRMGYVNYFSSKELKDNASKVDSSVTTEATSANKAIYEKYIDSLGNGWQLKRFPTSKQFYAIRNIPIYERVWNFFSNLVVIDHPWKIQDKDNPKLARYIRLEKDKSVGWSLVGSGTKHKYLLYTNGKFPYLHQNFVTLNLGTSYPTYSNIPVLQVISQGQGRTALQDVTFPSGVTKKSSVDIYSRSYKNPKSLDDITKVNYGKGDSYTKTINNYVDPSMIHNSFVIGFFGVMFSYIVGLPLGLFMARFKNTYFDSFSTATMTFMLALPSIAVIYVVRFLGGMVGLPDSFPMLGASDPKSYILPALILGILNIPTTVIWFRRYLVDLQASDWVRFARSKGLSESEIYRGHLFKNAMVPIVSGVPASIILAIGGATLTETVFAFPGMGKMLIDSIKSANNSMIVGLTFIFTVLSIVSLLLGDIVMTLVDPRIKLSTKKGGK

SEQ ID NO: 175 - protein, 308 aa, Streptococcus pyogenes
MESIDKSKFRFVERDSEASEVIDTPAYSYWKSVFRQFFSKKSTVFMLVILVTVLMMSFIYPMFANYDFNDVSNINDFSKRYIWPNAEYWFGTDKNGQSLFDGVWYGARNSILISVIATLINITIGVVLGAIWGVSKAFDKVMIEIYNIISNIPSMLIIIVLTYSLGAGFWNLILAFCITGWIGVAYSIRVQILRYRDLEYNLASQTLGTPMYKIAVKNLLPQLVSVIMTMLSQMLPVYVSSEAFLSFFGIGLPTTTPSLGRFIANYSSNLTTNAYLFWIPLVTLILVSLPLYIVGQNLADASDPRSHR

SEQ ID NO: 176 - protein, 220 aa, Streptococcus pyogenes
MFMNSDGHGDAGWGLAIWNTLYMTIVPFIVGGAIGLLLGLLLVLTGPDGVIENKTICWVIDKVTSIFRAIPFVILIAILASFTYLLLRTTLGATAALVPLTFATFPFYARQVQVVFSELDKGVIEAAQASGATFWDIVKVYLSEGLPDLIRVSTVTLISLVGETAMAGAIGAGGLGNVAISYGYNRFNNDVTWVATIIILLIIFAIQFIGDSLTRRFSHK

SEQ ID NO: 177 - protein, 261 aa, Streptococcus pyogenes
MAKLRCMHAIFIKQYLKQIMEYKVDFVVGVLGVFLTQGLNLLFLSVLFQHIPSLEGWTFEQIAFIYGFCLIPKGIDHLFFDNLWALGQRLVRKGEFDKYLTRPISPLFHVLVETFQVDALGELLVGVILLVTTAGSIVWTLPKVLLFILVIPFATLIYTSLKIATASISFWTKQSGAVIYIFYMFNDFSKYPMSIYHSFLRWLISFIIPFAFTAYYPASYFLTGQHLLFNIGGLVVVSLLVLALSLKLWKWGLDAYESAGS

SEQ ID NO: 178 - protein, 322 aa, Streptococcus pyogenes
VVNKMSLVTIFALLMSSMLIYATPLIFTSIGGTFSERSGVVNVGLEGIMVMGAFSGIVFNLEFAETFGKATPWIAVLVGGIVGLIFSLIHAVATINFRADHIVSGTVLNLLAPSFAVFLVKAMYGKGQTDNIQQSFGKFDFPGLSQIPVIGDIFFKNTSLIGYFAIAFSFFAWFLLYKTRFGLRLRSVGEHPQAADTLGINVYLMKYYGVMISGFLGGIGGAVYAQSISVNFAVTTILGPGFIALAAMIFGKWNPVGAMLSSLFFGLSQSLAVIGAQLPLLEKIPTVYLQIAPYMVTIIILAAFFGQAVAPKADGINYIKSK

SEQ ID NO: 179 - protein, 300 aa, Streptococcus pyogenes
MSLFSNLPPSVLQWFAIFMSIIIEALPFVLLGTILSGCIEVFVTPELVQKYLPKQKCLRILFGTFVGFVFPSCECGIIPIINRFLEKKVPSYTAVPFLATAPIINPIVLFATYSAFGNSLRFLILRLVGAALVAITLGVMLAFIVDDNILKDNAQPVHFHDYSHESLPKRIYLALVHAIDEFFDTGRYLVFGTLIASAMQIYVPTRVLTTIGHNPLTAILIMMLMAFILSLCSEADAFIGASLLSTFGVAPVLAFLLIGPMVDIKNLMMMVKAFKGRFIVQFIGVSVLMIAVYCLLVGVL

SEQ ID NO: 180 - protein, 434 aa, Streptococcus pyogenes
MIISRSRGKTMKIDKRHLLNYSILLPYLILSVIGLIMVYSTTSVSLIQAHANPFKSVINQGVFWIISLVAITFIYKLKLNFLTNTRVLTVVMLGEAFLLIIARFFTTAIKGAHGWIVIGPVSFQPAEYLKIIMVWYLALTFAKIQKNISLYDYQALTRRKWWPTQWNDLRDWRVYSLLMVLLVAAQPDLGNASIIVLTAIIMFSISGIGYRWFSAILVMITGLSTVFLGTIAVIGVERVAKIPVFGYVAKRFSAFFNPFHDLTDSGHQLANSYYAMSNGGWFGQGLGNSIEKRGYLPEAQTDFVFSVVIEELGLIGAGFILALVFFLILRIMNVGIKAKNPFNAMMALGVGGMMLMQVFVNIGGISGLIPSTGVTFPFLSQGGNSLLVLSVAVGFVLNIDASEKRDDIFKEAELSYRKDTRKENSKVVNIKQFQ

SEQ ID NO: 181 - protein, 319 aa, Streptococcus pyogenes
VMKKKEIMVTMIRYFFRHIWESIKNLKRNFWMTFASVSMVAVTLTLVGVFAATLLNIQRVASGVENNVHINTYLQVDSTDAAKVIQNTAGEPVNNDNYHSVYDKIAQIKGVKKITFSSKDEQLKKLQETLGDVWNMYDQDTNPLQDIYLIETQTPKQVKAITKKIRTIEGVEAADYGGINSDKLFKFSTLIQTWGLIGTAMLLFVAVFLISNTIRMTIMSRKRDIEIMRLVGAKNSYIRGPFFFEGAWVGLLGAVLPSLLIYYGYDLVYKHFAQELQRNNLSMYPLDPYVYYLIGALFVIGIMIGSLGSVLSMRRYLKF

SEQ ID NO: 182 - protein, 358 aa, Streptococcus pyogenes
MFLALNEMKQSKLRYGLIAGLLCLVAYLMFFLSGLAFGLMQENRSAVDLWKADSVLLAKDADATLTLSQVSRAQENQITADKVAPLAQLNTVAWSVKNPKDADKVKVSLFGIDSNSFIRPNIVKGRLFKTNKEVVLDQSLAKEEAFAIGKDFYTSSSSQALTIVGYTQNARFSVAPVVYMNLEAFETLKYGEPLPKDKQVVNAFITKGSLTDYPKKDFQKLDIKTFITKLPGYSAQLLTFGFMISFLVIISAIIIGIFMYILTIQKAPIFGIMKAQGISNKTITTAVLMQTFFLSFLGSGLGLLGTWLTSLLLPTVVPFQSNWFLYLAIFVSMICFALLGTLFSVFNIIRIDPLKAIG

SEQ ID NO: 183 - protein, 227 aa, Streptococcus pyogenes
MMLLVLLSFLGLTTLWLTSYRRRCLARWHLQWLVALSYQDFLDVLLSLFQFVVIILVLFFYSATINLGEVLTFLTQTSWHWQILCYLVLYLMAIIEMTLLVLILIFDVLLQKDSRLLFKKITWLPFRQDKPVLSILLLGTVILVDSLFYLGLLILLGEQSLTSLATLILGYGIVKACRYSGWLNVLLAFCLFTIVGLWAVTATLLYGWLVGAMILTVTYLMISCKEY

SEQ ID NO: 184 - protein, 428 aa, Streptococcus pyogenes
MINPSKQNQTIFLWNMLGSLSTAVISVILLMVVTRLLTSADSDIYAFAYSFANMMVVVGLFQVRNYQATDINEKYSFSQYLVARLMTCLLMLAITVIYLTLTKTDSYKSTIVFLVCFYRSTDAFSDLYQGMFQQHERLDIAGKSLAYRNTLIFMVYTAIILYSKNLTLALVAVCIVSLVFIMYYDIGHSKKFQKLMFSELLSNISFQNSLKLLKESFPLFLNGFLIIYIYTQPKYAIELMTTLGEVALGSQTIFNILFMPAFVMNLLILFFRPHITQMAIALIRGQIKEFNKIQVQLFAYLGVFSLIALVGSGLFGIPFLSILYGTNLTDYWVDFMLIMLGGSIGSFATVIDNILTAMRKQQLLLIPYTGGFLISLLITNLFVMKYHILGAALSFLITMLVWLGLSIMIYLFIMNRFKKGRVNATIYD

SEQ ID NO: 185 - protein, 498 aa, Streptococcus pyogenes
MQQSMTKVKYLWKENNNYIYSTFLTLLLTVILYANSLNLPLKFISLLFVVSTLLIVFLPKKLEVATIIFILVFGTISAIISPINDIPDEYVHYSRTVYISEGDINLTNNNKKLRISKDVDKLIKQSGKTFITSNLKATKHSTREYSYPYIKGTNAYYSFSYIPQALGILVGNALDLPILLTYYFGRLCNLISYAMLAFIAIKLSGSFKQVIAVVTLLPMNIYLAASFNQDGFAIGLVLVTIGLFINLLSSKDKSNYNTKFFLYLVLCGLLVLSKFTYFLLVCLPLFIPNEKFGKNTKLVILKKLGGLLLIFLFAAMWFRLYGQVKTPYVADFLKEVNVSQQVKNMLESPIVYSSIIIRHMVINLINMNNIFQFGALSYGITNLFPLYVCFFFFVYISNASKITINIVEKMGIIFVISAIIGATVLAMYLTWTPVGSSTVLGVQSRYLIGIIPLVLLLFSSQQQKFKQIEDILSDKLAIHVSLLFILAMLMSTIFRYYH

SEQ ID NO: 186 - protein, 406 aa, Streptococcus pyogenes
MENWKFALSSIWGHKMRSILTMLGIIIGVAAVVIIMGLGNAMKNSVTSTFSSKQKDIQLYFQEKGEEEDLYAGLHTHENNHEVKPEWLEQIVKDIDGIDSYYFTNSATSTISYEKKKVDNASIIGVSKDYFNIKNYDIVAGRTLTDNDYSNFSRIILLDTVLADDLFGKGNYKSALNKVVSLSDKDYLVIGVYKTDQTPVSFDGLSGGAVMANTQVASEFGTKEIGSIYIHVNDIQNSMNLGNQAADMLTNISHIKDGQYAVPDNSKIVEEINSQFSIMTTVIGSIAAISLLVGGIGVMNIMLVSVTERTREIGLRKALGATRLKILSQFLIESVVLTVLGGLIGLLLAQLSVGALGNAMTLKGACISLDVALIAVLFSASIGVFFGMLPANKASKLDPIEALRYE

SEQ ID NO: 187 - protein, 591 aa, Streptococcus pyogenes
LSGNELFKIKEISSMTFLSDLISLMTKIRLSWVIKAGIFQLLFVTIANIVLSEFFYFILDVTGQYHLDKDNVVTFLKNPIALALLGAYLFLLAAFIHLEFFALYRIIADQEISFYLFRKQFSYYLRGLWKTFSGYQLLLFLLYILLTIPVLHIGLSSVITQKLYLPEFIVGELSKITSTKYLLYGSLILVFYLNLRLVYFLPLIAINHRTVAQAWRESWQKTKKKHVLLWMKLFAINGLTIVVLSLAISMILIFVDMFNPKGNNIIVQLGALTFTWELIFFTTIFFKLCSAMILKEAIEPQKQYDEPRRSNKAYVVIFIVVTVGFAYQSLERLTFFDTSHSKTVIAHRGLVSAGVENSLEALEGAKKAGSDYVELDLILTKDNHFVVSHDNRLKRLAGVNKTIRNLTLKEVEHLTSHQGHFSGRFVSFDTFYQKAKKLNMPLLIELKPIGTEPGNYVDLFLETYHRLGISKDNKVMSLDLEVIEAIKKKNPSITTGYIIPIQFGFFGDEFVDFYVIEDFSYRSYLSSQAFWNNKEIYVWTINDPKRIEHYLLKPIQGIITDQPALTNQLIKDLKQDNSYFSRLVRIISSLY

SEQ ID NO: 188 - protein, 283 aa, Streptococcus pyogenes
MNNLSSIDIKFLLSLFADPWLLAVHLLDILIVAYLIYRFIKALTGTKIMSLVQGVIFFLVLRFIAEWIGFTTITYLMNQVITYGVIAGVVIFTPEIRAGLEKFGRSTQVFLQKQYVSSESALVDALIKSVAYMGPRKIGALIAIEQTQTLQEYIATGIPLNADISSQLLINIFIPNTPLHDGAVIVGQNKIVAACAYLPLSESKAISKEFGTRHRAAIGLSENSDALTIIVSEETGAISVTRKGQFLHDLSTDEFETVLRTYLMSNSNVTLPWYKKILGGKSK

SEQ ID NO: 189 - protein, 223 aa, Streptococcus pyogenes
MPLSIQCLNLCFLLVTFCPSIPMQAIFGKEDSGYAFNLIGFLRATLIYDILALVSIYVLSPQITLSLESIDSKTFFMGLVFCVLIVLIELVFLHGLRCWQKKQWLPATFSFVGTTNDWSKIGYPLLLALFEETIYRFLWFNILAFQWHLPTIIVLIVTSFCYALNHLLMGKSIFYAKLVTGIIYGSIYMLTSQLWLVVIMHVGGNLLVECLSHLQTKKKKEVT

SEQ ID NO: 190 - protein, 227 aa, Streptococcus pyogenes; identical to SEQ ID NO: 183

SEQ ID NO: 191 - protein, 375 aa, Streptococcus pyogenes
MVLFHLIKKESLQIFRNRTALLMMVIFPILMIVILSFAFKSSFNTATTVPKLTIRYQLEGEKTDYQKNFLAFLKVLNQKLHLETKPSNSLEKDRQRVSEGALTAVLEVKKNQTIKVITNNINQQNADLINMLVKNYVDNAKTYDSIAALYPQQLNHIRKRSVDYVKVSSIQTSKGMTSADYYAISMFTMITFYSMMSAMNLVLSDRQQRITNRIHLTGVSPSFLVFGKLIGAMLATTVQLSLLYIFTRFVLRVNWGTNEWMLIGITASLVYLSVAIGIGLGISIKNEAFLTVASNTIIPIFAFLGGSYVPLTTLHSSIINQLSNISPIKWVNDSLFYLIFGGQYNPIPVTLIVNISIGTIFIILALIGMRKQVTT

SEQ ID NO: 192 - protein, 371 aa, Streptococcus pyogenes
MICFIKTLFVKIKRKKTSYVTFFLMPILTTLLALSLSFSNNNQAKIGILDKDNSQISKQFIAQLKQNKKYDIFTKIKKEHIDHYLQDKSLEAVLTIDKGFSDKVLQGKSQKLNIRSIANSEITEWVKAQTNYLLENYNIIGDVALGNEDTFNRILQKNQQLNYDVKQVTLTDRSRSKAVSSTTTGFLLILMLGSTSVIYSGILADKSSQLYHRLMLSNLSRFRYMLSYVCVGFVAFTIQIVIMLSLLKVFNISFFVPTSLLLIIFFLFSLLAIGFGLLIGAITQNSQQSSQLANLIVMPTSMLAGCLWPLSITPSYMQAIGKLLPQNWVLSAIAIFQSGGTLSQAWPYLLALMGTALALISFSSLLLKPTK

SEQ ID NO: 193 - protein, 272 aa, Streptococcus pyogenes
MKSDFDFRKVSFRDTISKIILLKEKPVFYAYLRGLVVFLLWVVNGNAHYHHEEKMLDASENYILVAPHRTFWDPVYMAFAARPKQFIFMAKKELFANRLFAWWIKMCGAFPIDRDKPSPDAIRYPVNMLKKSNRSLLMFPSGSRHSQEVKGGVAVIAKLAKVKIMPAAYQGPMSVKGLLAGERVDMTFGNPIDVSDIKRMNDEGIAEVANRIQAEFDRIDDELAPFQPGKARNPLTYLYRLPLGLVLVVVLLLTMLFSYIASFVWNPDKHRH

SEQ ID NO: 194 - protein, 743 aa, Streptococcus pyogenes
MRNEMAKIMNVTGEEVIALAATYMTKADVAFVAKALAYATAAHFYQVRKSGEPYIVHPIQVAGILADLHLDAVTVACGFLHDVVEDTDITLDEIEADFGHDARDIVDGVTKLGEVEYKSHEEQLAENHRKMLMAMSKDIRVILVKLADRLHNMRTLKHLRKDKQERISRETMEIYAPLAHRLGISRIKWELEDLAFRYLNETEFYKISHMMKEKRREREALVEAIVSKVKTYTTQQGLFGDVYGRPKHIYSIYRKMRDKKKRFDQIFDLIAIRCVMETQSDVYAMVGYIHELWRPMPGRFKDYIAAPKANGYQSIHTTVYGPKGPIEIQIRTKDMHQVAEYGVAAHWAYKKGVRGKVNQAEQAVGMNWIKELVELQDASNGDAVDFVDSVKEDIFSERIYVFTPTGAVQELPKESGPIDFAYAIHTQIGEKATGAKVNGRMVPLTAKLKTGDVVEIITNANSFGPSRDWVKLVKTNKARNKIRQFFKNQDKELSVNKGRDLLVSYFQEQGYVANKYLDKKRIEAILPKVSVKSEESLYAAVGFGDISPISVFNKLTEKERREEERAKAKAEAEELVKGGEVKHENKDVLKVRSENGVIIQGASGLLMRIAKCCNPVPGDPIDGYITKGRGIAIHRSDCHNIKSQDGYQERLIEVEWDLDNSSKDYQAEIDIYGLNRSGLLNDVLQILSNSTKSISTVNAQPTKDMKFANIHVSFGIPNLTHLTTVVEKIKAVPDVYSVKRTNG

SEQ ID NO: 195 - protein, 323 aa, Streptococcus pyogenes
MKTRITELLNIDYPIFQGGMAWVADGDLAGAVSNAGGLGIIGGGNAPKEVVKANIDRVKAITDRPFGVNIMLLSPFADDIVDLVIEEGVKVVTTGAGNPGKYMERLHQAGIIVVPVVPSVALAKRMEKLGVDAVIAEGMEAGGHIGKLTTMSLVRQVVEAVSIPVIAAGGIADGHGAAAAFMLGAEAVQIGTRFVVAKESNAHQNFKDKILAAKDIDTVISAQVVGHPVRSIKNKLTSAYAKAEKAFLIGQKTATDIEEMGAGSLRHAVIEGDVVNGSVMAGQIAGLVRKEESCETILKDIYYGAARVIQNEAKRWQSVSIEK

SEQ ID NO: 196 - protein, 180 aa, Streptococcus pyogenes
MKHILFIVGSLREGSFNHQLAAQAQKALEHQAVVSYLNWKDVPVLNQDIEANAPLPVVDARQAVQSADAIWIFTPVYNFSIPGSVKNLLDWLSRALDLSDPTGPSAIGGKVVTVSSVANGGHDQVFDQFKALLPFIRTSVAGEFTKATVNPDAWGTGRLEISKETKANLLSQAEALLAAI

SEQ ID NO: 197 - protein, 448 aa, Streptococcus pyogenes
MAITVADIRREVKEKNVTFLRLMFTDIMGVMKNVEIPATKEQLDKVLSNKVMFDGSSIEGFVRINESDMYLYPDLDTWIVFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDEADKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 198 - protein, 604 aa, Streptococcus pyogenes
MCGIVGVVGNRNATDILMQGLEKLEYRGYDSAGIFVANANQTNLIKSVGRIADLRAKIGIDVAGSTGIGHTRWATHGQSTEDNAHPHTSQTGRFVLVHNGVIENYLHIKTEFLAGHDFKGQTDTEIAVHLIGKFVEEDKLSVLEAFKKSLSIIEGSYAFALMDSQATDTIYVAKNKSPLLIGLGEGYNMVCSDAMAMIRETSEFMEIHDKELVILTKDKVTVTDYDGKELIRDSYTAELDLSDIGKGTYPFYMLKEIDEQPTVMRQLISTYADETGNVQVDPAIITSIQEADRLYILAAGTSYHAGFATKNMLEQLTDTPVELGVASEWGYHMPLLSKKPMFILLSQSGETADSRQVLVKANAMGIPSLTVTNVPGSTLSREATYTMLIHAGPEIAVASTKAYTAQIAALAFLAKAVGEANGKQEALDFNLVHELSLVAQSIEATLSEKDLVAEKVQALLATTRNAFYIGRGNDYYVAMEAALKLKEISYIQCEGFAAGELKHGTISLIEEDTPVIALISSSQLVASHTRGNIQEVAARGAHVLTVVEEGLDREGDDIIVNKVHPFLAPIAMVIPTQLIAYYASLQRGLDVDKPRNLAKAVTVE

SEQ ID NO: 199 - protein, 256 aa, Streptococcus pyogenes
MTDVSRILKEARDQGRLTTLDYANLIFDDFMELHGDRHFSDDGAIVGGLAYLAGQPVTVIGIQKGKNLQDNLARNFGQPNPEGYRKALRLMKQAEKFGRPVVTFINTAGAYPGVGAEERGQGEAIAKNLMEMSDLKVPIIAIIIGEGGSGGALALAVADQVWMLENTMYAVLSPEGFASILWKDGSRATEAAELMKITAGELYKMGIVDRIIPEHGYFSSEIVDIIKANLIEQITSLQAKPLDQLLDERYQRFRKY

SEQ ID NO: 200 - protein, 525 aa, Streptococcus pyogenes
MIIKKKAKVKYLLHKGKHGFLRGIFSRTTIIVLLIILQLVFLFQSYAWMEQYRVWITILESVFAITIVLYLVNSDMDAISRMTWLILIMIAPLLGSLFLIYTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMSSGVKIYEYQPGFVHSKVFISDNTKAVVGTINLDYRSLYHHFECATYLYRVSVIADIVNDFNEAQKQSLLMTSDHLTQRPWYQKLIGLLVRIIAPLL

SEQ ID NO: 201 - protein, 271 aa, Streptococcus pyogenes
MPDKKQFPISYISHCLSPRAMFASRAQFTWWQNLLIIVFLNALIMIPVTLHYANMTTYPLERIVTKSLSPITDKTYQALTQGKIEKDTFQGQSLIRRDGELVLAVLPTKVDLEQLASESTRQIIVTKKEWRFVTPDGKELRAHVRGQQQSLADLTTVKAVKDFVNQQWYDSNKASVLGFLLLTFVLMVCVGTLIVIGLGAFFLTLTKRSRLFMIRNFSEGLGLMVNCLAWPSLLAIALSFFIQDPVLIMNCQVFGTLLMLTWVFYKTQFRD

SEQ ID NO: 202 - protein, 269 aa, Streptococcus pyogenes
VKQITQQKWLRYGLFIALVLNGIELELLGLTANNLSFKEAFALILTISLLGIYLIPFAAAIFYLSKKFHMNLNVIIVSCLSGLYISGFLASCGNHLVGQFWSYIIPSKDALKLWGDALTAPIVEEPIKASSAILVITLFPRLTLKEKLVVALLSGMGFQLTEDIRYLIQAKSIDSLVPTAIERISTAVTSHWVHTAIFTIGAYLLLKGSNLFSKQQQIFWLLSPLVLHFIWNSPLTSIPGMTVLLGTLILLIFGDLFQKINTLDDDVLF

SEQ ID NO: 203 - protein, 267 aa, Streptococcus pyogenes
MTSVFLTSGWAFYDYLISPIPHGKLFSWHAVFDAIPNIIQRLPITLGLTLSGATFGLVLALIFALVKINKVKLLYPIQAIFVSFLRGTPILVQLMLTYYGIPLFLKFLNQKYGFDWNVNAIPASIFAITAFAFNEAAYASETIRAAILSVDTGEIEAAKSLGMTSVQVYRRVIIPNATVVAIPTLINGLIGLTKGTSLAFNAGIVEMFAQAQILGGSDYRYFERYISVALVYWSISILMEQVGRLIENKMAIKAPEQARNEKLGELR

SEQ ID NO: 204 - protein, 303 aa, Streptococcus pyogenes
MTEQIKLTKSDRQRVWWRSQFLQGSWNYERMQNMGWAYALIPALKKLYTSPEDRAAALERHMEFFNTHPYVAAPIIGVTLALEEERANGTPIDDKAIQGVKIGMMGPLAGIGDPVFWFTIRPILGALGASLASTGNIVGPLLFFFGWNLIRMAFLWYTQEFGYKAGSEITKDMSGGILQDITKGASILGMFILAVLVQRWVSINFTIDLPGKQLSDGAYVVFPDGAVKGAELKTILANAIGGMSLDKVQAQTLQGQLDSLIPGLAGLLLTFLCMWLLKKKVSPIAIIIGLFAFGILAHLAGIM

SEQ ID NO: 205 - protein, 290 aa, Streptococcus pyogenes
MKKRGIDLLLVTIGSFITAIGFNTMFVDNHIASGGMVGIAVVIKALFGISPSLFLMASNIPLLLMCYFFLGKQNFIKTLYGSWIYPIAIRSTNSLPTLTHNQLLAAIFGGIICGIGLGMVFWGNSSTGGTGILTQILHKYSPLSLGVAMTIVDGISVLMGFIALSADDVMYSTIGLFVIGYVISVMENGFDSSKNVMIISKDYQAIREYITTVMDRGVTKLPIRGGYTTSDKIMLMAIVSSHELPTLQEKILEIDDTAFIVVMPAAQVMGRGFSLTKQYKREDKDVLLPM

SEQ ID NO: 206 - protein, 443 aa, Streptococcus pyogenes
METISKKMPQKDLSEHSKAWQNRRIGSVPLPVYLVLATLILVTGWLQQLPVNMLGGFAVILTLGWLLGTIGATIPGLKHFGGPAILSLLVPSILVFFNLLNPNVLEATNVLMKQANFLYFYIACLVCGSILGMNRKILIQGLFRMIIPMLLGMVCAMGVGTLVGVILGLDWQHTLFYVVTPVLAGGIGEGILPLSLGYSAITGVGSEQLVAQLIPATIIGNFFAILCTALLNRFGEKHPSYSGQGQLVKIGHSEDMSDALKDNSGALDVKLMGAGVLTACSLFIAGGLLQHLTDFPGPVLMIILAAFLKYLNVIPQETQNGAKQLYKFISSNFTFPLMAGLGLLYIPLKEVVATLSWQYFIVVISVVLTVVSVGFFVSRFLNMSPVEAAIISACQSGMGGTGDVAILSTADRMNLMPFAQVATRLGGAITVITMTAILRIIFS

SEQ ID NO: 207 - protein, 382 aa, Streptococcus pyogenes
MIIKGVTMKFEKKQVFYLVLTFILCYGILANWRNGTAIVTTIYKTSLPFFYGAAGAYIVNIVMSAYEKVYVYIFKDWSHVLKVKRGICLLLAYLTFFILITWIISIVIPDLITSISTLTKFDTITIQEVVNNLEHNKLLARTIQYIGGDGKLTETIANYSQQLLKQFLTVLTNILTSVTVIASAIINLFISFVFSLYVLASKEDLCRQGNTLVDTYTGKYAKRIHYLLELLHQRFHGFFVSQTLEAMILGSLTASGMFILRLPFAGTIGVLVAFTALIPVIGASIGAAIGFILIMTQSMSQAIIFIIFLIILQQIEGNFIYPKVVGGSIGLPAMWVLMAITIGASLKGIVGMIIAVPLAATLYQVIKDNIQKRQAIQKKQVS

SEQ ID NO: 208 - protein, 520 aa, Streptococcus pyogenes
MLLWSIYLEVMSMPSLFVTFQNRFNEWLAALGEHLQISLLSLMIALLIGVPLAALLSRSKRWSDIMLQVTGVFQTIPSLALLGLFIPLMGIGTLPAVTALVIYAIFPILQNTITGLNGIDPSLVEAGIAFGMTKWERLKTFEIPIAMPVIMSGVRTSAVMIIGTATLASLIGAGGLGSFILLGIDRNNANLILIGAISSALLAIIFNSLLQYLEKASLRRIMISFGITLLALLASYTPMALSQFSKGKDTVVIAGKLGAEPDILINLYKELIEDQSDISVELKSNFGKTSFLYEALKSGDIDMYPEFTGTITSSLLRDKPPLSNDPKQVYEDAKKGIAKQDKLTLLKPFAYQNTYAVAMPEKLAKEYQIETISDLKAHADTLKAGFTLEFKDRADGYKGMQSQYGLQLSVATMEPALRYQAIQSGDIQVTDAYSTDAEITKYHLKVLKDDKQLFPPYQGAPLMKTSLLTKHPELKGILNQLAGKITEKEMQDMNYEVSVKGADANKVARDYLLKTGLIQK

SEQ ID NO: 209 - protein, 575 aa, Streptococcus pyogenes
MIKTDHHLLKRVLQDLLKKPLPVCILVIASFVQVGLSVYLPVLIGKAVDMSLSVNSWQTLKWLLGQMLVIIVVNTLIQWVMPLVYSRLLYQYSQQLKDKLLEKIHRLPFAYLDRQTIGDLVSRVITDTEQLINGLQMVFNQFILGLLTILCTIIAMAQIDWLMLILVLVLTPSSLFLARFIAQKSFHYAQAQTKSRGNLAQFTEEILRQEGLVQLFNAQEQSICDYHVLNKTYCEASQKAIFYASTVNPATRFINSVIYALLAGLGAVRIMAGLFSVGQLTTFLNVVVQYTKPFNDISSVLAEIQSSLACAQRLYDLLDIEIKEQEHFLTFKASAVKGQIDFEEVSFSYQKDRPLLKDINFSVPAGSKVAIVGPTGAGKSTLINLLMRFYELDAGSIKLDKVPIKCYAKEELRSITGIVLQETWLKDATVHELIAYGSEEASRDEVVAAAKAAHAHFFIMQLPKTYDTYLSASDDALSQGQLQLLAIARMFLKKPKVLVLDEATSSIDIRTEAVIQEALKELMRGRTSFIIAHRLSTIQSADLILVMDQGRLVEWGTHASLMSKNGCYVRLQKIE

SEQ ID NO: 210 - protein, 216 aa, Streptococcus pyogenes
MNQTFKQSLPLSFSEEVANSVTHAIGAFAMLILLPISASYAYQTYDLKAAIGISIFVISLFLMFLSSTIYHSMAYGSVHKYILRIIDHSMIYIAIAGSYTPVALSLVSGWLGYIIIVLQWGITLFGILYKIFAKRINEKFSLMLYIVMGWLVVFILPVIIQKTSLAFGLLMLFGGLSYTIGAVFYAKKRPYFHMIWHLFILLASALQFIAITFFML

SEQ ID NO: 211 - protein, 295 aa, Streptococcus pyogenes
MNAKKVDKVATGTLYTIAGIIVAILASLILYILVRGLPHISWSFLTGKSSSYEAGGGIGIQLYNSFFLLIVTLIISIPLSTGAGIYLAEYAKKGPVTNFIRTCIEILSSLPSVVVGLFGYLIFVVQFEYGFSIISGALALTVFNLPQMTRNVEDSLLHVHHTQREAGLALGLSRWETVFYVVIPEALPGMVTGIVLASGRIFGEAAALIYTAGQSAPALDWSNWNPLSVTSPISIFRQSETLAVHIWKVNSEGTIPDATLVSAGSAAVLLIFILIFNFSAHFIGKKLHSKMTAAK

SEQ ID NO: 212 - protein, 318 aa, Streptococcus pyogenes
MGSVERTLKMTLATIVAILIAYQLHLDYAMSAGIIALLSVLDTRKSSLVVARNRLLSFFLAFGIAMMCFSLFGFTTVGFMCYLLIIIPLLYHFQIEAGLVPITVLVTHLIAKKSIALPILSNEFMLFFVGTSVALLFNAYMGPQDQQIRYYHQKVESDLKGILYRFESFLLEGKGQNEGLLIKNLDKILDEALKLVYRERHNQLFQQTNYQVHYFEMRRQQNRLLGQMAINVNTLMRQSKESILLSHLFHETACQLSEQNPALTLIDDIEQLLETFRHGDLPQTREEFERRAVLFQLLQDLERFILLKVEFYQDYQND

SEQ ID NO: 213 - protein, 878 aa, Streptococcus pyogenes
MIKKTLWKDILRAIKNSKGRFISLFFLMALGSFALVGLKVTGPDMERTASRYLERHQVMDLTVLASHQFSQADKQELDTLKGAHLEYGHLLDVSLTSNQKSLRLYSVPKKVSKPVLVKGSWPKRETDLVLSSSLAKNYQIGDELAVTSPMEGLLTTTHFQVVGFANSSEVWSKSNLGSSSTGDGSLYAYAFVNPNVFKSAFNLLRIRFSHLRLTNAFSKDYQKRVTQNQAHLDNLLKDNGQKRYDDLQNQYDLALKNGRAALAKETVKLAASEENLTFLEGSALQEAKHQIEQGKQALAKEEKQLEQVQATKDKLEKPSYLTYNRSTLPGGEGYHTYATSTTSISNVGNIFPVVLYLVAALVAFTTMTRYVDEERTSSGLLKAIGYSNKDISLKFLIYGLLASFLGTTLGIIGGTYLLSTLISEILTGALTIGKTHLYSYWFYNGIAYLLAMLSAVLPAYLIVKKELFLNAAQLLLPKPPSKGAKIWLEHLTFVWKALSFTHKVTIRNIFRYKQRMLMTIVGVAGSVALLFAGLGIQSSLAKVVEHQFGDLTTYDILAVGSAKATATEQTDLASYLKQEPITGYQKVSYASLTLPVKGLPDKQSISILSSSATSLSPYFNLLDSQEQKKVPIPTSGVLISEKLASYYKVKPGDQLVLTDRKGQSYKVTIKQVIDMTVGHYLIMSDTYFKNHFKGLEAAPAYLIKVKDKDSKHIKETASDLLTLKAIRAVSQNVNHIKSVQLVVTSLNQVMTLLVFLSILLAIVILYNLTTINIAERIRELSTIKVLGFYDQEVTLYIYRETISLSLVGILLGIYLGKGLHTYIMTMISTGDIQFGVKVDAYVYLVPILVILSLLAVLGIWVNRHLKKVDMLEALKSID

SEQ ID NO: 214 - protein, 411 aa, Streptococcus pyogenes
MTQDPIANLKLARKGPIVSIIVYLSLSVAKLLAGYLLNASSLIADGFNNLSDIVGNVALLIGLHLASQPADANHKFGHWKIEDLSSLVTSFIMFLVGFQVLIHTIKSIFSGQQVDIDPLGAIVGIVSAFVMLGVYVFNKRLSKRVKSSALVAASKDNLADAVTSIGTSIAIIAASLHLPVIDHIAAMIITFFILKTAFDIFMESSFSLSDGFDSRHLKKYEKAILEIPKIVAVKSQRARTYGSNVYLDIVLEMNPDLSVYESHSITEKVEQLLSDQFSIYDIDIHVEPAMIPEEEIFDNVAKKLYRYEKLILSKVPDYDHYIAKSFQLIDANGQTVNYEQFLNQEIYYPSNFNHFQIESISQKTMLVTYQLNGNQRTSIWRRHESWSLLFHQITPIAKKQLHHTHYRIVKM

SEQ ID NO: 215 - protein, 418 aa, Streptococcus pyogenes
MMMFFSHIPYMEPYGNPIYFVYLILAFLPVIIGIFKQKRLSTYETLVSLVFILFMFGGDHYQQLVAFLFYLLWQIISVFAYQKYRENANSAGVFYLAIAMALFPLIWVKVAPLTGPSSQTLFSFLGISYLTFKSIGMIIEMRDGTLQEVRLPDFIRFMIFFPTFSSGPIDRFRHFQEDYHKLPERDDYFAMLNKAVMYLMLGFLYKHIISYCLGGILLPLLENKALMVGGYFNKETILVMYVYGLNLFFDFAGYSMFAIGISYLLGIRTPENFNMPFLSASLKDFWNRWHMSLSFWFRDYVFMRLVHLLIKHKTFKNRNVTSGVAYLVNMLVMGFWHGLTWYYIAYGLFHGIGLIINDAWIRKKKEINRHRKKKGLSPLFQSRAFHVLCIVVTFHVVMFSLLLFSGFLNDLWFNRPLH

SEQ ID NO: 216 - protein, 724 aa, Streptococcus pyogenes
MTHKIKVLLLAIMSIFLTCNIASAETIAIVSDTAYAPFEFKDSDQIYKGIDVDIINEVAKRQSWDFSMSFPGFDAAVNAVQSGQASALMAGTTITNARKKVFHFSEPYYDTKIVIATRKANAIKKYSDLKGKTVGVKNGTAAQAFLNNYKKKYDYTVKTFDTGDLMYNSLSAGSIAAVMDDEAVIQYAISQNQDIAINMKGEPIGSFGFAVKKGSGYDYLVNDFNTALKAMKADGTYQAIMTKWLGTDDKATTSQATGNPSAKATPTKDSYKIVSDSSFAPFEFQNGKGKYVGIDIELIKAIAKQQGFKIEIANPGFDAALNAVQSSQADGVIAGATITDARKAIFDFSDPYYTSNIILAVKAGKNIKNYEDLDRKTVGAKNGTSSYSWLKENAPKYGYNVKAFDDGSSMYDSLNSGSVDAIMDDEAVLKYAISQGRRFETPLEGISTGEVGFAVKKGTNPELIEMFNNGLAALKKSGQYDDIIDKYLDSKKAATPSEKGADESTISGLLSNNYKQLLAGLGTTLSLTLISFAIAIIIGIIFGMMAVSPTKSLRLISTVFVDVVRGIPLMIVAAFIFWGVPNLIESMTGHQSPINDFLAATIALSLNGGAYIAEIVRGGIEAVPAGQMEASRSLGLSYGTTMRKVILPQAVKLMLPNFINQFVISLKDTTIVSAIGLVELFQTGKIIIARNYQSFRMYAILAIIYLIMIILLTRLAKRLEKRLN

SEQ ID NO: 217 - protein, 321 aa, Streptococcus pyogenes
MAEKKWFDKVLSKWQYEPIQVFMRHLQSAEMDLSAIAVAYYLILTAFPLIVIAANIFPYLNIDIADLLRLMKQNLPKDIFRPASAIVENIFSKPSGSVLGVATLTGLWTMSRSLTSLQKAINKAYGASQHRDFFIGHLVGLLTSLIILFLLAFALIFSIFSKAAIQVLDKHYHLSDNITTIFLLLIQPITVLIIFVGLMLLYFLLPNVKIKKIRYILPGTLFTSFVMTFLSNLVGNYVVYNVERMVDIKMFGSVMIFIIMLWFIFLARILILGAIFNATYQEMSLGKLEGRSGDMIAILKKTLGNDSDLSPSQSIEDSHTD

SEQ ID NO: 218 - protein, 437 aa, Streptococcus pyogenes
MTIIIMDSNSAHETDNLSVSFLNFCYNSLMKRHFLLLTFYLFLTGLTAGLVAFILTKAIHLIQSLSFGFSQGSFSTMIASVPPQRRALSLLFAGLLAGLGWHLLAKKGKDIQSIQQIIQDDISFSPWTQFWHGWLQLTTVSMGAPVGREGASREVAVTLTSLWSQRCNLSKADQKLLLACASGAALGAVYNAPLATILFILEAILNRWSLKNIYAACLTSYVAVETVALLQGRHEIQYLMPQQHWTLGTLIGSVLAGLILSLFAHAYKHLLKHLPKADAKSQWFIPKVLIAFSLIAGLSIFFPEILGNGKAGLLFFLHEEPHLSYISWLLVAKAVAISLVFASGAKGGKIAPSMMLGGASGLLLAILSQYLIPLSLSNTLAIMVGATIFLGVINKIPLAAPVFLVEITGQSLLMIIPLALANLIFYFSYQFYRFILK

SEQ ID NO: 219 - protein, 308 aa, Streptococcus pyogenes
MEKKKKVEKVNVRTFDRKTNAIFNILIGLFAISCIIPFIFVIIISFTDESYLINHGYSFFPDVWSTKAYQYIFQGAMSHRIMRSFGISVFITVVGTFINTTMTSTYAYAISRPYFPYRRFFTVYALITMLFAPGMVANYLVVSNLLHLKDTVWALILPMALGPFGILVMRTFFKKTVPDSIIESARMDGASEWMIFMKIVLPLAVPGIATISLFSALTYWNDWFNALLYVQSENLYPMQYLLMKIQSNLQALAQNAGMSAQMADSLASLPKESVRMAIVVIATLPIALTYPFFQKYFVGGLTIGGVKE

SEQ ID NO: 220 - protein, 228 aa, Streptococcus pyogenes
MQFSRNSDKIQRNKGKLMKKFQFFLLIECILLAMGIMTILDNDLSSFILILVLILLALRFYNQDSRNNFLLTVSLLFLFLIFMLNPYIIMAVLLGIVYIFINHFSQVKKKNRFALIRFKEEKIEVNNTKHQWIGTANYESDYYCFDDINIIRISGNDTVDLTNVIVTGMDNIIVIRKIFGNTTILVPIDVTVTLDVSSIYGSVDFFRCQQYDLRNESIKFKETDNQSL

SEQ ID NO: 221 - protein, 556 aa, Streptococcus pyogenes
MAKPNRSTLSLVWRLLTLMKTLLPWIILAVGFAVMGFVITVSIPTGIAYLGLLAIRQEVIPILALYLLIALAFLRGFVRYGEHYFGHFVAFHSLAAFRNLIFKKLRALSPACLDSQDSGYLLKMIGEDIEALEVFFAHTIAPICTAILSAGLMFWYFCQSSWQLALLALATYACLAIVIPIYFANILQVLLKSQNEGRKDYLSYFLESLRSVKDLLQFQVLDEQFERLIKKSNHVNALDRNVAQAQFLQMALTFFWLGLMILAFSYMVFDGICHDSLSFDKGLLTFIAFTASFSPFLELGRLPLGFKRAMNAARNIFDLLDENVIVDEGTKQIDRLRSVSFEDLSFAYPKRQELVFKDLTVTFQEKGIIGIKGESGSGKSTLVKLIMKWYNWKTGDIFLNDRNSCLLNAAKLQDTIAYVPQTAQLFQQSIRENLIFGRQDISDESIWNLAEACGMKDRLLACKEGLDTIIKSPSDFSAGEGQRLELMRALLKDASCYIFDEPTSNLDSLNEAILLDLIKTHCQGLVFLISHRPSTLACVDHLFCVKNGSLKEVNKK

SEQ ID NO: 222 - protein, 587 aa, Streptococcus pyogenes
MMETEDTISRGKRKRLLKRLRERIAPKRYLLYVSAFLSWLQFVMRMISFYLIAKTFSTFILGHAIALGRLAGLLLLLNVVGFVLAILGKQLQGIASQFARDSLKQSFFEAFIDLDGQFDAHASDADILTLASQGIDSLDTYYGYYLSLSMRTKWNCTTIMILVFLIYPLAGLVFLGVLPLIPLSIVAMQKRSQPNMSHYWSSYMDVGNLFMDDLKGLNTLYSYQATERYEQEFSGKAEQFRKATMSLLGFQLQAVGYMDAVMYLGIGLSGFLAVQALATGQLSFFNFLFFLLIATEFFTPIREQGYGMHLVMMNTKMADRIFSFLDSVPARKDNKSKTAINFNQIDIQNISLAYEKKTVLSGVTMTLTKGQLTAIAGVSGQGKTSLAQLLLKRQSATTGHILFDGLDSDNLSQETINQQVLYVSDQSTLLNRSIYDNLRLAANLSKKEILDWIDQHGLLSFINWLPDGLDTIVGENGNLLSPGQKQQVICARALLSKRSLYIFDEATSSLDAENERIIDNLITRLAKTAIVIVITHKMSRLKGANQVLFLNTGQPACLGKPCDLYRDQPTYRHLVDTQARLEASIYG

SEQ ID NO: 223 - protein, 635 aa, Streptococcus pyogenes
MIWSITKSNIKKNFSLYRIYFLATIGLLSIFIAFLNFISDKIITEKIGDSGQALVIANGSLIFLIVFLVVFLIYFNNFFVKKRSQELGVLAILGFSKRELTKLLTLENLVILVLSYLVSLLLGPTLYFLAVLAITHLLNLTMEVQWFITVNEIIESLGILVVVFLINVITNGLIISKQSLIEFVNFSRKAEKKIKIRKVRAIIAITALLLSYILCLATVFSSTRNMLLSIGMVPVSLLIIVLVVLGTVFTIRYGLAFVVSLLKENKKRLYRPLSNIIYPKFNYRIATKNKLLTVLGGLLTVTVSVAGMMVMLYAYSLNGIERLTPSAIEYNVESENGQVNVTTILENDQVSLVDVGLLRLNTIPEVTITDSGQTIPYFDIINYSDYKELMKAQGRTNSIEGSKSLPLLINYYPTEISLGKTFNLGNAYDVTVKQVSTNNVFSFSTSVTTLVVSDKLYAKLSSRFPEKEMTIRTFNGTSIRSSEAFYNQFSMVPDVISSYSKEHTVKTANIATYIFITFLSILFIICTGSILYFTSLIEIMENKEEYGYLSKLGYSKKMIHRILRYETGILFLIPVFIGIVNGGMLLIYYKYLFMDTLVAGNIIMLSLLLCLLFFLIIYGTFYVLTLRLVTSIIKN

SEQ ID NO: 224 - protein, 419 aa, Streptococcus pyogenes
MLGIITFIIIFGILVIVHEFGHFYFAKKSGILVREFAIGMGPKIFSHVDQGGTLYTLRMLPLGGYVRMAGWGDDKTEIKTGTPASLTLNEQGFVKRINLSQSKLDPTSLPMHVTGYDLEDQLSITGLVLEETKTYKVAHDATIVEEDGTEIRIAPLDVQYQNASIGGRLITNFAGPMNNFILGIVVFILLVFLQGGMPDFSSNHVRVQENGAAAKAGLRDNDQIVAINGYKVTSWNDLTEAVDLATRDLGPSQTIKVTYKSHQRLKTVAVKPQKHAKTYTIGVKASLKTGFKDKLLGGLELAWSRAFTILNALKGLITGFSLNKLGGPVAMYDMSNQAAQNGLESVLSLMAMLSINLGIFNLIPIPALDGGKILMNIIEAIRRKPIKQETEAYITLAGVAIMVVLMIAVTWNDIMRVFF

SEQ ID NO: 225 - protein, 325 aa, Streptococcus pyogenes
VKRTTIIIIWKIIRCVTLIFGVSVLTFVLLKQSPVDPVMASVNYDTSLTPAQYKAIAHHYGLDKPALVQYFIWLKNVIQGDLGTSLVYRQPVSDIIRSRAGASFILMGLSWILSGLIGFILGTLSAFHQGKLLDRVVRWFSYLQISVPTFWIGLIFLLIFSVQLGWFPIGISSPIGTLSQDITLADRVKHLMLPVFTLSILGIANVTLHTRTKMMSVLSSEYVLFARARGETQWQIFKHHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 226 - protein, 405 aa, Streptococcus pyogenes
MEDIIAALSSILSHKMRSILTMLGIIIGIGAIIAIFSIIEGNTENTKRQLIGGSNNTINIVFNKKSSIDPKFPDKSNAKKPDYLPFMAEEELSKIQQVKGVKNALISYGIDDKVYHLGQKSSAKISAITKNVAEVRRMTFIKGSDFSDKDFIDQKQVIYLEKSLYESLFPKDDGLGKFVEVMGNPFRVIGVFESKEQSGLTSGTEKIAYIPLHQWYNINGVVDATPEITIQTYRADDLKPVAKRVSDMLNQTIPKSDYMFGVMNLKEFERQLDNLNKSNFVLLAGIASISLIVGGIGVMNIMLVSVTERTREIGIKKALGARRKLILKQFLIEAVILTLLGGVIGVISGMVSGLIITRSLEYPYILSLFSVVLSLAFCCIIGIVFGLLPAIKASKLDPIEALRFE

SEQ ID NO: 227 - protein, 447 aa, Streptococcus pyogenes
MMLTKGQLPYSAAFTTGGLFYFVIIALSYYLGSTLWLVFVQVFCFYLSGLYLYKLINYMTGFQKVALTFSISYYLLSVSLGFGGLYPTQLAMPFILISAWFLTKYFACLVKDEAFILFGFVGALAMLIDPSTLIFWSFACVTVFSYNISQKHLARGFYQLLASIFGMILVFYTAGYFILNLQVLNPYLSQTMIYPFTFFKSGNLSLLFGLAIQLFFALGLGLLTGMENVIRRFKNNSDRVVKWLFVMVILESILVAIFSQDYRPYHLLPLLPFGLILTAIPVGYQYGIGLGQSSHRRRHGKNGVGRVMMIYLKRHFYLPILIVGTILICSTYCFISSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 228 - protein, 406 aa, Streptococcus pyogenes
MQEFLNLPKQIQLRQLVRFVTITLGSSIFPFMAMYYTTYFGTFWTGLLMMITSLMGFVGTLYGGHLSDALGRKKVIMIGSVGTTLGWFLTILANLPNAAIPWLTFAGILLVEIASSFYGPAYEAMLIDLTDESNRRFVYTINYWFINIAVMFGAGLSGLFYDHHFLALLVALLLVNVLCFGVAYYCFDETRPETHAFDHGKGLLASFQNYRQVFHDRAFVLFTLGAIFSGSIWMQMDNYVPVHLKLYFQPTAVLGFQVTSSKMLSLMVLTNTLLIVLFMTVVNKLTEKWKLLPQLVVGSLLFTLGMLLSFTFTQFYAIWLSVVLLTFGEMINVSASQVLRADMMDHSQIGSYTGFVSMAQPLGAILASLLVSVSHFTGPLGVQCLFAVIALLGIYFTVVSAKMKKV

SEQ ID NO: 229 - protein, 313 aa, Streptococcus pyogenes
MIKKTTYKKKVKYVISRGAKKVGLLHALRSISREKYAEKISASLLYGILSSIAVNFFFQPGHVYSSGATGLAQVFSALSHRLLGYDFPIAFAFYLINIPLLILAWYKIGHQFTIFTFITVSMSSFFIQIMPQVTLTTDPLINAIFGGLVMGMGIGTGLKSRISSGGTDIVSLTLRKRTGKDVGSLSLMVNGAILAFAGILFGWQYALYSMVSIFVSSRVTDAIFTKQKKMQATIVTSHPERVIHMIHKRLHRGVTSINDAEGTYKHEQKAVLITILTCEEYPEFKWLMLKTDPQAFVSVAENVRIIGRFVEDD

SEQ ID NO: 230 - protein, 757 aa, Streptococcus pyogenes
MLEELKTLIKNPKLMITMIGVALVPALYNLSFLGSMWDPYGRVNDLPIAVVNHDKPAKRADKSLTIGNDMVDKMSKSKDLEYHFVSAKQAQEGLKEGDYYMVITLPEDLSQRAATLLNPEPQKLTIRYQTSKGHGMVAAKMGETAMAKLKESVSQNITKTYTSAVFSSMTDLQSGLKEASAGSQALASGAKTAQAGSQTLSTNLAALTGASQQFQQGTGRLTSGLTTYTDGVNQVKNGLGTLSTDIPNYLNGVSRLSQGASQLNQGLSQLTQATTLSDEKAKGIQSLIVGLPVLNQGIQQLNTELSTLQPPNLNADELGNSLGAIAQAAKQVIAEETAAQNEELSALQATSVYQSLTAEQQGELAAALSQSDKSQTVSAAQTILSSVQTLSTSLQSLSQEDQSKQLEQLKEAVAQIANQSNQALPGASSALTELSTGLAKVNGSLNQQVLPGSNQLTTGLAQLNRYNTAIGSGVIKLSEGANALSSKSGELLDGSHQLSEGATKLADGSSQLSQGGHQLTSGLTELSTGLSTLNGSLAKASQQLSLVSVTDKNAKAVAKPLVLNEKDKDGVKTNGIGMAPYMIAVSLMVVALSTNVIFANSLSGRPVKDKWDWAKQKFVINGFISTMGSIVLYLAIQLLGFEARYGMETLGFIMLSGWTFMALVTALVGWDDRYGSFASLVMLLLQVGSSGGSYPIELSGAFFQKLHPFLPMTYVVSGLRQTISLSGHIGVEVKVLTGFLLAFMVLALLIYRPKKTV

SEQ ID NO: 231 - protein, 857 aa, Streptococcus pyogenes
MKNNNKWIIAGLASFLFPLSIIFIILLSMGIYYNSDKTILASDAFHQYVIFAQNFRNIMHGSDSFFYTFTSGLGINFYALMCYYLGSFFSPLLFFFNLTSMPDAIYLFTLIKFGLIGLAACYSFHRLYPKISAFLMISISVFYSLMSFLTSQMELNSWLDVFILLPLVILGLNKLITENKTRTYYLSISLLFIQNYYFGYMIALFCILYALVCLLRLNDFNKMFIAFVRFTAVSICAALTSALVILPTYLDLSTYGENLSPIKQLVTNNAWFLDIPAKLSIGVYDTTKFNALPMIYVGLFPLMLSVIYFTLESIPLKIKLANACLLTFIIISFYLQPLDLFWQGMHSPNMFLHRYAWSFSIVILLLACETLSRLKEVTQIKAGFAFIFLIILTSLPYSFSQQYNFLPLTLFLLSVFLLLGYTISLFSFRNSQIPSTFISAFILIFSLLESGLNTYYQLQGINKEWGFPSRQIYNSQLKDINNLVNSVSKNSQPFFRMERLLPQTGNDSMKFNYYGISQFSSVRNRLSSSLLDRLGFQSKGTNLNLRYQNNTIIMDSLLGIKYNLSEGPPNKFGFTKLKTSGNTTLYQNHYSSPLAILTRNVYKDVNLNVNTLDNQTKLLNQLSGKSLTYFNLQPAQLISGANQFNGQISAQASDYQNSVTLNYQINIPKHSQLYVSIPNIIFSNPDAKEMRIQTDNHNFIYTTDNAYSFFDLGYFADAKVATFSFVFPKNKQISFKEPHFYSLSIESYLEAMNSIKQKNVHTYAKSNTVITDYNSKTKGSLIFTLPYDKGWSAQKDGKNLPVKKAQGGFLSVTIPKGKGRVILTFIPNGFKLGLSLSCVGIIAYMLLYKYIDIKSKL

SEQ ID NO: 232 - protein, 281 aa, Streptococcus pyogenes
MSFKKWIGIVGIALASTVLVACSEKQDDKNTLTIGVMTKTESDQARWDKVEELLKKDNITLKYKEFTDYSQPNKAVANGEVDINAFQHYNFLNNWNKENKEHLVAIADTYISPINLFSGTSQDGKAKYKSVADLPNGTQIAVPNDATNESRALYVLQSAGLIKLNVSGDQLATIANISENKKKLDIKELDASQTARALVSADAAVVNNSYAVPAKIDYKTSLFKEKADDNSKQWINIIAGQKDWEKSEKADAIKKLIKAYQTDEVKKVVEKTSNGIDVSVW

SEQ ID NO: 233 - protein, 935 aa, Streptococcus pyogenes
MSVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRASGGGSMAFNTSQSVSAQVYSNEGYHQHLTDEKSHLQYSKDNAQLQLRNILDGYQNDLGRHYSSYYYYNLRTVMGLSSEQDIEKHYEELKNKLHDMYNHYAAALEHHHHHH

SEQ ID NO: 234 - protein, 935 aa, Streptococcus pyogenes
MAFNTSQSVSAQVYSNEGYHQHLTDEKSHLQYSKDNAQLQLRNILDGYQNDLGRHYSSYYYYNLRTVMGLSSEQDIEKHYEELKNKLHDMYNHYASGGGSMSVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNGLAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRAAALEHHHHHH

SEQ ID NO: 235 - protein, 836 aa, Streptococcus pyogenes
MSVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRAAALEHHHHHHH

SEQ ID NO: 236 - DNA, 8 bp, Streptococcus pyogenes
aaaaaaaa

SEQ ID NO: 237 - protein, 835 aa, Streptococcus pyogenes
SVGVSHQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQDIPADRNRFVDPDNLTPEVQNELAQFAAHMINSVRRQLGLPPVTVTAGSQEFARLLSTSYKKTHGNTRPSFVYGQPGVSGHYGVGPHDKTIIEDSAGASGLIRNDDNMYENIGAFNDVHTVNGIKRGIYDSIKYMLFTDHLHGNTYGHAINFLRVDKHNPNAPVYLGFSTSNVGSLNEHFVMFPESNIANHQRFNKTPIKAVGSTKDYAQRVGTVSDTIAAIKGKVSSLENRLSAIHQEADIMAAQAKVSQLQGKLASTLKQSDSLNLQVRQLNDTKGSLRTELLAAKAKQAQLEATRDQSLAKLASLKAALHQTEALAEQAAARVTALVAKKAHLQYLRDFKLNPNRLQVIRERIDNTKQDLAKTTSSLLNAQEALAALQAKQSSLEATIATTEHQLTLLKTLANEKEYRHLDEDIATVPDLQVAPPLTGVKPLSYSKIDTTPLVQEMVKETKQLLEASARLAAENTSLVAEALVGQTSEMVASNAIVSKITSSITQPSSKTSYGSGSSTTSNLISDVDESTQRAAALEHHHHHHH

SEQ ID NO: 238 - protein, 102 aa, Streptococcus pyogenes
MANKKIRIRLKAYEHRTLDTAAEKIVETATRTGATVAGPVPLPTERSLYTIIRATHKYKDSREQFEMRTHKRLVDIINPTQKTVDALMKLDLPSGVNVEIKL

SEQ ID NO: 239 - protein, 92 aa, Streptococcus pyogenes
MGRSLKKGPFVDEHLMKKVEAQANDEKKKVIKTWSRRSTIFPSFIGYTIAVYDGRKHVPVYIQEDMVGHKLGEFAPTRTYKGHAADDKKTRR

SEQ ID NO: 240 - protein, 217 aa, Streptococcus pyogenes
MGQKVHPIGMRVGIIRDWDAKWYAEKEYADYLHEDLAIRKFINKELADASVSTIEIERAVNKVIVSLHTAKPGMVIGKGGANVDALRGQLNKLTGKQVHINIIEIKQPDLDAHLVGENIARQLEQRVAFRRAQKQAIQRTMRAGAKGIKTQVSGRLNGADIARAEGYSEGTVPLHTLRADIDYAWEEADTTYGKLGVKVWIYRGEVLPARKNTKGGK

SEQ ID NO: 241 - protein, 180 aa, Streptococcus pyogenes
MANRLKEKYTNEVIPALTEKFNYTSVMAVPKVEKIVLNMGVGDAVSNAKNLEKAAAELALISGQKPLITKAKKSIAGFRLREGVAIGAKVTLRGERMYEFLDKLVSVSLPRVRDFHGVPTKSFDGRGNYTLGVKEQLIFPEISFDDVDKVRGLDIVIVTTANTDEESRELLKGLGMPFAK

SEQ ID NO: 242 - protein, 164 aa, Streptococcus pyogenes
MAFKDNAVELEERVVAINRVTKVVKGGRRLRFAALVVVGDGNGRVGFGTGKAQEVPEAIRKAVEAAKKNMIEVPMVGTTIPHEVYTNFGGAKVLLKPAVEGSGVAAGGAVRAVIELAGVADITSKSLGSNTPINIVRATVEGLKQLKRAEEVAALRGISVSDLA

SEQ ID NO: 243 - protein, 128 aa, Streptococcus pyogenes
MAYRKLGRTSSQRKAMLRDLTTDLLINESIVTTEARAKEIRKTVEKMITLGKRGDLHARRQAAAYVRNEIASENYDEATDKYTSTTALQKLFSEIAPRYAERNGGYTRILKTEPRRGDAAPMAIIELV

SEQ ID NO: 244 - protein, 1188 aa, Streptococcus pyogenes
MAGHEVRYGKHRTRRSFSRIKEVLDLPNLIEIQTDSFQDFLDSGLKEVFEDVLPISNFTDTMELEFVGYEFKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDSKDIAYTRIDRTRKIPFTTLVRALGFSGDDEIVDIFGESDLVRNTIEKDIHKNPSDSRTDEALKEIYERLRPGEPKTADSSRSLLIARFFDARRYDLAAVGRYKVNKKLNIKTRLLNQIIAENLVDAETGEILVEAGTEMTRSVIESIEEHLDGDLNKFVYTPNDYAVVTEPVVLQKFKVVSPIDPDRVVTIVGNANPDDKVRALTPADILAEMSYFLNLAEGLGKVDDIDHLGNRRIRAVGELLANQFRIGLARMERNVRERMSVQDNDVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRATGTVTNEIVWLTADEEDEYTVAQANSKLNEDGTFAEEIVMGRHQGNNQEFSASVVDFVDVSPKQVVAVATACIPFLENDDSNRALMGANMQRQAVPLIDPKAPYVGTGMEYQAAHDSGAAVIAQQNGKVVFSDAEKVEIRRQDGSLDVYHITKFRRSNSGTAYNQRTLVKVGDIVEKGDFIADGPSMENGEMALGQNPVVAYMTWEGYNFEDAVIMSERLVKEDVYTSVHLEEFESETRDTKLGPEEITREIPNVGEEALKDLDEMGIIRIGAEVKEGDILVGKVTPKGEKDLSAEERLLHAIFGDKSREVRDTSLRVPHGGDGIVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWDTVREAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDIMHVDDLEKAREKQAQETQEVSETTDEK

SEQ ID NO: 245 - protein, 131 aa, Streptococcus pyogenes
MIIKRNDMAPSVKAGDAILFYRLSQTYKVEEAVVYEDSKTSITKVGRIIAQAGDEVDLTEQGELKINGHIQNEGLTFIKSREANYPYRIADNSYLILNDYYSQESENYLQDAIAKDAIKGTINTLIRLRNH

SEQ ID NO: 246 - protein, 156 aa, Streptococcus pyogenes
MSRKNQAPKREVLPDPLYNSKIVTRLINRVMLDGKRGTAATIVYDAFNAIKEATGNDALEVFETAMDNIMPVLEVRARRVGGSNYQVPVEVRPERRTTLGLRWLVNASRARGEHTMKDRLAKEIMDAANNTGASVKKREDTHKMAEANRAFAHFRW

SEQ ID NO: 247 - protein, 229 aa, Streptococcus pyogenes
MAKKSKQMRAALEKVDSTKAYSVEEAVALVKETNFAKFDASVEVAYNLNIDVRKADQQIRGAMVLPNGTGKTQRVLVFARGAKAEEAKAAGADFVGEDDLVAKINGGWLDFDVVIATPDMMAIVGRLGRVLGPRNLMPNPKTGTVTMDVAKAVEESKGGKITYRADKAGNVQALIGKVSFDADKLVENFKAFHDVMAKAKPATAKGTYMANVSITSTQGVGIKVDPNSL

SEQ ID NO: 248 - protein, 398 aa, Streptococcus pyogenes
MAKEKYDRSKPHVNIGTIGHVDHGKTTLTAAITTVLARRLPSSVNQPKDYASIDAAPEERERGITINTAHVEYETATRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDTKFEDIIMELMDTVDSYIPEPERDTDKPLLLPVEDVFSITGRGTVASGRIDRGTVRVNDEIEIVGIKEETKKAVVTGVEMFRKQLDEGLAGDNVGILLRGVQRDEIERGQVIAKPSSINPHTKFKGEVYILSKDEGGRHTPFFNNYRPQFYFRTTDVTGSIELPAGTEMVMPGDNVTINVELIHPIAVEQGTTFSIREGGRTVGSGIVSEIEA

SEQ ID NO: 249 - protein, 244 aa, Streptococcus pyogenes
MTENIKEALEYAVNTAHEKPKTILGSDGKEYYDRNKYSLVELKTKYYPKTLNLNTLDSLIDYLKSDMNNINSKRLMVIVEGPREVIVCEEDDDDLNRNVLVTVEAIIPNVQFGHYDSPSDFNISLQSLFVNADDRNTVIEFASALKIENGSEIVDDGIGQTATIKQGVASLAKAKAPNPVTLRPYRTFSEVEQPSSEFIFRINQLANMALFEADGGKWRLDAINNIANYLKEELADQTNITILA

SEQ ID NO: 250 - protein, 204 aa, Streptococcus pyogenes
MHMENVTNENVDQETTDLENNQQEDKAFTQDDLNRVGTKEHSKGYNKAVKDLGFDDVESAKDALKAFQEWQESQRSESEKQTEILNAKDKELEEARANNKALNAKLAAMSLGVNAESIDDVIALSERLVTDETSIEDAIKTVLGKYPHFGQTKDKAPKITVAGNPSADNGQGSVSKEDFAKMSYQEKLDLKLKNKNLYDQLKGN

SEQ ID NO: 251 - protein, 272 aa, Streptococcus pyogenes
MAVGTTKMAQMLDPEVLADMIDAEVGKAIRFAPLAEVDTTLEGQPGTTLTVPKWDYIGDAEDVAEGEAIPMTQLGFKKTTMTIKKAGKGVEITDEAILSGYGDPVGQAAKQIVEAIDHKVDADVLDALSKSTQTVEATATVDGVSKALDIFNDEDDAETVIVMNPADASTLRLDAAKEWLGATEVGANRVVSGVYGEVLGVQIVRSRKCPKGTAYMVRKGALRIMLKRNTMVETDRDITKAINQIVANKHYGVYLYKAEKAVKITLKDAAKK

SEQ ID NO: 252 - protein, 86 aa, Streptococcus pyogenes
MRKDIHPDYRPVVFLDTTTGYQFLSGSTKASKETVEFEGETYPLIRVEISSDSHPFYTGRQKFTQADGRVDRFNKKYGLKDANAAK

SEQ ID NO: 253 - protein, 581 aa, Streptococcus pyogenes
MNRILLYVHFNKYNKISAHVYYQLEQMRSLFSKIVFISNSKVSHEDLKRLKNHCLIDEFLQRKNKGFDFSAWHDGLIIMGFDKLEEFDSLTIMNDTCFGPIWEMAPYFENFEEKETVDFWGITNNRGTKAFKEHVQSYFMTFKNQVIQNKVFQQFWQSIIEYENVQEVIQHYETQLTSILLNEGFSYQTVFDTRKAESSFMPHPDFSYYNPTAILKHHVPFIKVKAIDANQHIAPYLLNLIRETTNYPIDLIVSHMSQISLPDTKYLLSQKYLNCQRLAKQTCQKVAVHLHVFYVDLLDEFLTAFENWNFHYDLFITTDSDIKRKEIKEILQRKGKTADIRVTGNRGRDIYPMLLLKDKLSQYDYIGHFHTKKSKEADFWAGESWRKELIDMLVKPADSILSAFETDDIGIIIADIPSFFRFNKIVNAWNEHLIAQEMMSLWRKMDVKKQIDFQAMDTFVMSYGTFVWFKYDALKSLFDLELTQNDIPSEPLPQNSILHAIERLLVYIAWGDSYDFRIVKNPYELTPFIDNKLLNLREDEGAHTYVNFNQMGGIKGALKYIIVGPAKAMKYIFLRLMEKLK

SEQ ID NO: 254 - protein, 401 aa, Streptococcus pyogenes
MNEFEDLLNSVSEVNPGDVVTAEVLTVDNGQANVVIEGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVIEEAAKEARAEVFSKISEGAVVTGTVARLTSFGAFIDLGGVDGLVHVTELSHERNVSPKSVVSVGEEVEVKVLSIDEEAGRVSLSLKATTPGPWDGVEQKLAQGDVVEGKVKRLTDFGAFVEVLPGIDGLVHISQISHKRVENPKDVLSVGQEVTVKVLEVNAADERVSLSIKALEERPAQAEGDNKEEKRQSRPRRPKRESRRDYELPETQTGFSMADLFGDIEL

SEQ ID NO: 255 - protein, 401 aa, Streptococcus pyogenes; identical to SEQ ID NO: 254

SEQ ID NO: 256 - protein, 469 aa, Streptococcus pyogenes
MAFEIIMPKLGVDMQEGEIIEWKKQEGDTVNEGDILLEIMSDKTNMELEAEDSGVLLKITRQAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGANKMCLSDFVLASKDVIKKAQTGKLKAAEMSGSTFSITNLGMFGTKTFNPIINQPNSAILGVGATIPTPTVVDGEIVSRPIMAMCLTIDHRLVDGMNGAKFMVDLKKLMENPFELLI

SEQ ID NO: 257 - protein, 121 aa, Streptococcus pyogenes
MALNIENIIAEIKEASILELNDLVKAIEEEFGVTAAAPVAAAAAGGAEEAAKDSFDVELTSAGDKKVGVIKAVREITGLGLKEAKGLVDGAPANVKEGVAAAEAEEIKAKLEEAGATITLK

SEQ ID NO: 258 - protein, 229 aa, Streptococcus pyogenes
MLKIQNLKKSYGKRTILNNVNMNIPKGKVYALIGPNGAGKSTIMKILTGLVSKTSGSIIFEGREWSRRDLRKIGSIIEEPPLYKNLSAYDNMKVVTTMLGVSESTILPLLNKVGLGNIDKRPVKQFSLGMKQRLGIAISLINSPKLLILDEPTNGLDPIGIQELREIIESFKSEGMTIMISSHILSEVEHLADFIGFIYEGKIILEKEYDGSENLEELFNNQILFEKRR

SEQ ID NO: 259 - protein, 519 aa, Streptococcus pyogenes
MAFESLTQRLQDVFKHIRGKKKLSESDVQEVTKEIRLALLEADVALPVVKTFIKRVRERAIGHEIIDTLDPTQQILKIVNEELTSILGSETAEIDKSPKIPTIIMMVGLQGAGKTTFAGKLANKLIKEENARPLMIAADIYRPAAIDQLKTLGQQINVPVFDMGTDHSAVDIVRKGLEQARENHNDYVLIDTAGRLQIDEKLMGELRDVKALAQPNEILLVVDSMIGQEAANVAYEFNHQLSITGVVLTKIDGDTRGGAALSVREITGKPIKFTGIGEKITDIETFHPDRMSSRILGMGDLLTLIEKASQEYDEKKSLELAEKMRENTFDFNDFIEQLDQVQNMGPMEDLLKMIPGMAGNPALANIKVDENQIARKRAIVSSMTPAERENPDLLNPSRRRRIAAGSGNSFVDNKFIKDFNQAKSMMQGVMSGDMSKMMKDMGINPNNLPKNMPAGMPDMSSLEGMMGQGGMPDLSGLGGDMDMSQLFGKGFKGKIGQFAMKQAMKRQANKLKKAKKKRK

SEQ ID NO: 260 - protein, 163 aa, Streptococcus pyogenes
MMEKTQIKSTLTYDDKVIEKIVGHALENVGGLLAVTGGFFSNIKNNLVNSESVTDGVSVEVGSKEVAVDLAIIVEYGKDIPAIAESIKAIVSQNVDSMTHLKVVEVNVNVVDIRTKEEHEAASVTVQDRVTSAASSTSQFVSEQTEKLKDTISDTVNSDEAAK

SEQ ID NO: 261 - protein, 185 aa, Streptococcus pyogenes
MVKRDFIRNILLLLIVIIGAILLRIFVFSTFKVSPETANTYLKSGDLVTIKKNIQPKYKDFVVYRVGKKDYVSRVIAVEGDSVTYMDDIFYLNNMVESQAYLEKMKAHYLNHAPFGTLYTDDFTVATITADKYQKVPKGKYLLLNDNRKNTNDSRRFGLINASQIKGLVTFRVLPLSDFGFVEVE

SEQ ID NO: 262 - protein, 182 aa, Streptococcus pyogenes
MIKFSIRGENIEVTEAIRDYVESKLTKIEKYFAKDQEIDARVNLKVYRERSSKVEVTIPLDSVTLRAEDVSQDMYGSIDLVVDKIERQIRKNKTKIAKKHREKVPTGQVFTTEFEAEEVDEIPEVQVVRTKNVTLKPMDVEEARLQMELLGHDFFIYTDSEDGATNILYRREDGNLGLIEAK

SEQ ID NO: 263 - protein, 953 aa, Streptococcus pyogenes
MSKKRLHEIAKEIGKSSKEVVEHAKYLGLDVKSHASSVEEADAKKIISSFSKASKPDVTASQTVKPKEVAQPSVTVVKETGSEHVEKTQVSKPKSRNFKAEREARAKEQAARKQANGSSHRSQERRGGYRQPNNHQTNEQGDKRITHRSQGDTNDKRIERKASNVSPRHDNHQLVGDRNRSFAKENHKNGRFTNQKKQGRQEPQSKSPKIDFKARAAALKAEQNAEYSRQSETRFRAQQEAKRLAELARQEAKEAALKAQAEEMSHREAALKSIEEAETKLKSSNISAKSTADNRRKKQARPEKNRELTHHSQEGQKKNKKSWNSQNQVRNQKNSNWNKNKKTKKGKNVKNTNTAPKPVTERKFHELPKEFEYTEGMTVAEIAKRIKREPAEIVKKLFMMGVMATQNQSLDGDTIELLMVDYGIEAKAKVEVDDADIERFFEDENYLNPENIVERAPVVTIMGHVDHGKTTLLDTLRNSRVATGEAGGITQHIGAYQIEEAGKKITFLDTPGHAAFTSMRARGASVTDITILIVAADDGVMPQTIEAINHSKAAGVPIIVAINKIDKPGANPERVIAELAEYGIISTAWGGECEFVEISAKFNKNIDELLETVLLVAEVEELKADPTVRAIGTVIEARLDKGKGAIATLLVQQGTLHVQDPIVVGNTFGRVRAMVNDLGRRVKSAEPSTPVSITGLNETPMAGDHFAVYADEKAARAAGEERSKRALLKQRQNTQRVSLDNLFDTLKAGEIKTVNVIIKADVQGSVEALAASLVKIEVEGVRVNVVHSAVGAINESDVTLAEASNAVIIGFNVRPTPQARQQADTDDVEIRLHSIIYKVIEEVEEAMKGKLDPVYQEKILGEAIIRETFKVSKVGTIGGFMVINGKVTRDSSVRVIRDSVVIFDGKLASLKHYKDDVKEVGNAQEGGLMIENFNDLKVDDTIEAYIMEEIVRK

SEQ ID NO: 264 - protein, 312 aa, Streptococcus pyogenes
MTKTAFLFAGQGAQKLGMARDFYDNFAIVRKTFDQASQVLGYDLRRLIDSDELKLNQTSYTQPAILTSSIAIYRVLGLHHVKPDMVAGLSLGEYSALVASGALSFEDTLSLVAKRGRLMEEAAPQGSGKMVAVMNTDVQVIEEVCQIAAKHGVVAPANYNTPSQIVIGGQTDAVNVAVELLKERGVKRLIPLNVSGPFHTALLEPASRLLAKELERYNFSDFKIPLVGNTEANIMEKDRIPELLARQVMEPVRFYDSVATLVESGITQFIEVGPGKVLTGFVKKIDKNLLCTSVENMVSLRLFLDREDIHGN

SEQ ID NO: 265 - protein, 839 aa, Streptococcus pyogenes
MANILRKVIENDKGELRKLEKIAKKVESYADQMASLSDRDLQGKTLEFKERYQKGETLEQLLPEAFAVVREAAKRVLGLFPYRVQIMGGIVLHNGDVPEMRTGEGKTLTATMPVYLNAIAGEGVHVITVNEYLSTRDATEMGEVYSWLGLSVGINLAAKSPAEKREAYNCDITYSTNSEVGFDYLRDNMVVRQEDMVQRPLNFALVDEVDSVLIDEARTPLIVSGAVSSETNQLYIRADMFVKTLTSVDYVIDVPTKTIGLSDSGIDKAESYFNLSNLYDIENVALTHFIDNALRANYIMLLDIDYVVSEDGEILIVDQFTGRTMEGRRFSDGLHQAIEAKEGVRIQEESKTSASITYQNMFRMYKKLAGMTGTAKTEEEEFREVYNMRIIPIPTNRPIARIDHTDLLYPTLESKFRAVVEDVKTRHAKGQPILVGTVAVETSDLISRKLVEAGIPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGSDRIKAFLDRMKLDEEDTVIKSGMLGRQVESAQKRVEGNNYDTRKQVLQYDDVMREQREIIYANRRDVITANRDLGPEIKAMIKRTIDRAVDAHARSNRKDAIDAIVTFARTSLVPEEFISAKELRGLKDDQIKEKLYQRALAIYDQQLSKLRDQEAIIEFQKVLILMIVDNKWTEHIDALDQLRNAVGLRGYAQNNPVVEYQAEGFKMFQDMIGAIEFDVTRTMMKAQIHEQERERASQRATTAAPQNIQSQQSANTDDLPKVERNEACPCGSGKKFKNCHGRKSFS

SEQ ID NO: 266 - protein, 104 aa, Streptococcus pyogenes
MALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 267 - protein, 66 aa, Streptococcus pyogenes
MSEEKLKSKIEQASGGLKEGAGKLTGDKELEAKGFVEKTIAKGKELADDAKEAVEGAVDAVKEKLK

SEQ ID NO: 268 - protein, 543 aa, Streptococcus pyogenes
MAKDIKFSADARAAMVRGVDMLADTVKVTLGPKGRNVVLEKAFGSPLITNDGVTIAKEIELEDHFENMGAKLVSEVASKTNDIAGDGTTTATVLTQAIVHEGLKNVTAGANPIGIRRGIETATATAVEALKAIAQPVSGKEAIAQVAAVSSRSEKVGEYISEAMERVGNDGVITIEESRGMETELEVVEGMQFDRGYLSQYMVTDNEKMVADLENPFILITDKKVSNIQDILPLLEEVLKTNRPLLIIADDVDGEALPTLVLNKIRGTFNVVAVKAPGFGDRRKAMLEDIAILTGGTVITEDLGLELKDATMTALGQAAKITVDKDSTVIVEGSGSSEAIANRIALIKSQLETTTSDFDREKLQERLAKLAGGVAVIKVGAPTETALKEMKLRIEDALNATRAAVEEGIVAGGGTALITVIEKVAALELEGDDATGRNIVLRALEEPVRQIALNAGYEGSVVIDKLKNSPAGTGFNAATGEWVDMIKTGIIDPVKVTRSALQNAASVASLILTTEAVVANKPEPATPAPAMPAGMDPGMMGGF

SEQ ID NO: 269 - protein, 255 aa, Streptococcus pyogenes
MAVISMKQLLEAGVHFGHQTRRWNPKMAKYIFTERNGIHVIDLQQTVKLADQAYEFVRDAAANDAVILFVGTKKQAAEAVADEATRAGQYFINHRWLGGTLTNWGTIQKRIARLKEIKRMEEEGTFDVLPKKEVALLNKQRARLEKFLGGIEDMPRIPDVMYVVDPHKEQIAVKEAKKLGIPVVAMVDTNADPDDIDIIIPANDDAIRAVKLITAKLADAIIEGRQGEDADVAFEADTQADSIEEIVEVVEGDNA

SEQ ID NO: 270 - protein, 346 aa, Streptococcus pyogenes
MAEITAKLVKELREKSGAGVMDAKKALVETDGDMDKAVELLREKGMAKAAKKADRVAAEGLTGVYVHGNVAAVVEVNAETDFVAKNAQFVELVNATAKVIAEGKPANNDEALALVMPSGETLAEAYVNATATIGEKISFRRFALIEKADEQHFGAYQHNGGRIGVISVVEGGDDALAKQVSMHIAAMKPTVLSYTELDAQFIKDELAQLNHAIELDNESRAMVDKPALPFLKYGSKAQLSDDVITAAEADIKAELAAEGKPEKIWDKIIPGKMDRFMLDNTKVDQAYTLLAQVYIMDDSKTVEAYLDSVNAKAIAFARFEVGEGIEKKANDFESEVAATMAAALNN

SEQ ID NO: 271 - protein, 203 aa, Streptococcus pyogenes
MSRYTGPSWKQSRRLGLSLTGTGKELARRNYVPGQHGPNNRSKLSEYGLQLAEKQKLRFSYGLGEKQFRNLFVQATKIKEGTLGFNFMVLLERRLDNVVYRLGLATTRRQARQFVNHGHILVDGKRVDIPSYRVDPGQVISVREKSMKVPAILEAVEATLGRPAFVSFDAEKLEGSLTRLPERDEINPEINEALVVEFYNKML

SEQ ID NO: 272 - protein, 656 aa, Streptococcus pyogenes
MKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDSAVDIPVVALGGTPRVTKAVPFSGGFSWAGSKGPLAYKGMKLQDKPVTAKQYENAKEKWMKAKAKSNAKYAEKLADHVEK

SEQ ID NO: 273 - protein, 656 aa, Streptococcus pyogenes
MKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDNAVDIPVVALGGTPRVTKAVPFSGGFSWAGSKGPLAYKGMKLQDKPVTVKQYEKAKEKWMKAKAKSNAKYAEKLADHVEK

SEQ ID NO: 274 - protein, 520 aa, Streptococcus pyogenes
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 275 - protein, 291 aa, Streptococcus pyogenes; identical to SEQ ID NO: 114

SEQ ID NO: 276 - protein, 484 aa, Streptococcus pyogenes; identical to SEQ ID NO: 119

SEQ ID NO: 277 - protein, 550 aa, Streptococcus pyogenes; identical to SEQ ID NO: 134

SEQ ID NO: 278 - protein, 7 aa, Streptococcus pyogenes
YASGGGS

SEQ ID NO: 279 - protein, 8 aa, Streptococcus pyogenes
  VARIANT (1)...(8): Xaa = Any Amino Acid
RGDLPXTG

SEQ ID NO: 280 - protein, 6 aa, Streptococcus pyogenes
GSGGGG

SEQ ID NO: 281 - protein, 836 aa, Streptococcus pyogenes; identical to SEQ ID NO: 235

SEQ ID NO: 282 - protein, 13 aa, Streptococcus pyogenes
VRFTDVAGAEEEK

SEQ ID NO: 283 - protein, 22 aa, Streptococcus pyogenes
FTDVAGAEEEKQELVEVVDFLK

SEQ ID NO: 284 - protein, 22 aa, Streptococcus pyogenes
AAQNQVSALQAQVSSLQSEQDK

SEQ ID NO: 285 - protein, 16 aa, Streptococcus pyogenes
AQEQAAQQAASVEAAK

SEQ ID NO: 286 - protein, 14 aa, Streptococcus pyogenes
NAPISNPDESFKRE

SEQ ID NO: 287 - protein, 13 aa, Streptococcus pyogenes
QIENPNKEIVEPY

SEQ ID NO: 288 - protein, 11 aa, Streptococcus pyogenes
ALIPNTDFTFK

SEQ ID NO: 289 - protein, 17 aa, Streptococcus pyogenes
TSEDQFPGGQITTFGLK

SEQ ID NO: 290 - protein, 16 aa, Streptococcus pyogenes
EGGVSLTTDALTQDTK

SEQ ID NO: 291 - protein, 14 aa, Streptococcus pyogenes
IDIEVTEVHQGQNK

SEQ ID NO: 292 - protein, 15 aa, Streptococcus pyogenes
DILALSEVTFGNIER

SEQ ID NO: 293 - protein, 16 aa, Streptococcus pyogenes
YSDGVYQYEYDSELTK

SEQ ID NO: 294 - protein, 17 aa, Streptococcus pyogenes
HIENSESELIFPSISVK

SEQ ID NO: 295 - protein, 16 aa, Streptococcus pyogenes
GYIRTASGDTPGANSL

SEQ ID NO: 296 - protein, 26 aa, Streptococcus pyogenes
QNTASTETTTTNEQPKPESSELTTEK

SEQ ID NO: 297 - protein, 18 aa, Streptococcus pyogenes
NINTTPVDISIIDSVTDR

SEQ ID NO: 298 - protein, 12 aa, Streptococcus pyogenes
VGTVSDTIAAIK

SEQ ID NO: 299 - protein, 12 aa, Streptococcus pyogenes
MAAQTELMAAQR

SEQ ID NO: 300 - protein, 15 aa, Streptococcus pyogenes
GQFENLAVAEESIYR

SEQ ID NO: 301 - protein, 15 aa, Streptococcus pyogenes
AVVNFGLDLPVPEDK

SEQ ID NO: 302 - protein, 15 aa, Streptococcus pyogenes
GLDLPVPEDKQIVNF

SEQ ID NO: 303 - protein, 16 aa, Streptococcus pyogenes
GANTNGSQFYINQNKK

SEQ ID NO: 304 - protein, 16 aa, Streptococcus pyogenes
SQKQPEVPQEAVPTPK

SEQ ID NO: 305 - protein, 13 aa, Streptococcus pyogenes
QPEVPQEAVPTPK

SEQ ID NO: 306 - protein, 10 aa, Streptococcus pyogenes
AAETTEVEPK

SEQ ID NO: 307 - protein, 45 aa, Streptococcus pyogenes
TDISEAPTSANRPVPNESASEEVSSAAPAQAPAEKEETSAPAAQK

SEQ ID NO: 308 - protein, 45 aa, Streptococcus pyogenes; identical to SEQ ID NO: 307

SEQ ID NO: 309 - protein, 17 aa, Streptococcus pyogenes
EAPTSANRPVPNESASE

SEQ ID NO: 310 - protein, 20 aa, Streptococcus pyogenes
SGKGLDVRKDEHKKALEAVA

SEQ ID NO: 311 - protein, 18 aa, Streptococcus pyogenes
TYDNVTGDVYLNDVANGR

SEQ ID NO: 312 - protein, 12 aa, Streptococcus pyogenes
TDFIPNDYPAQK

SEQ ID NO: 313 - protein, 9 aa, Streptococcus pyogenes
EVFHQYGLK

SEQ ID NO: 314 - protein, 15 aa, Streptococcus pyogenes
QSASSGYDSLLRTPK

SEQ ID NO: 315 - protein, 12 aa, Streptococcus pyogenes
WFGDDVATANIK

SEQ ID NO: 316 - protein, 17 aa, Streptococcus pyogenes
EIAATSTDQALVGAQYK

SEQ ID NO: 317 - protein, 21 aa, Streptococcus pyogenes
FGDGSVASFESGPWDYEAAQK

SEQ ID NO: 318 - protein, 11 aa, Streptococcus pyogenes
VTIGGETVQQK

SEQ ID NO: 319 - protein, 16 aa, Streptococcus pyogenes
LASYLTNAESQENQFK

SEQ ID NO: 320 - protein, 15 aa, Streptococcus pyogenes
EVQSSEAVQSNELAK

SEQ ID NO: 321 - protein, 15 aa, Streptococcus pyogenes
ADFSTDTIYQIVTDR

SEQ ID NO: 322 - protein, 14 aa, Streptococcus pyogenes
FDSGATNVPTDVVK

SEQ ID NO: 323 - protein, 33 aa, Streptococcus pyogenes
AAEENPSESEQTQTSSAEEPTETEAQTQEPAAQ

SEQ ID NO: 324 - protein, 14 aa, Streptococcus pyogenes
GDTISVSDFYNETK

SEQ ID NO: 325 - protein, 18 aa, Streptococcus pyogenes
AAETQALYLQGYQLATDR

SEQ ID NO: 326 - protein, 19 aa, Streptococcus pyogenes
SIVLDIDETVLDNSPYQAK

SEQ ID NO: 327 - protein, 16 aa, Streptococcus pyogenes
LDIDETVLDNSPYQAK

SEQ ID NO: 328 - protein, 14 aa, Streptococcus pyogenes
STTQVDATMENLQK

SEQ ID NO: 329 - protein, 13 aa, Streptococcus pyogenes
TALLSDLQEEFGR

SEQ ID NO: 330 - protein, 15 aa, Streptococcus pyogenes
TRPPYGEALGTGYEK

SEQ ID NO: 331 - protein, 18 aa, Streptococcus pyogenes
TTYTFDSGETTLPAEVVR

SEQ ID NO: 332 - protein, 15 aa, Streptococcus pyogenes
DGFITAIDGIEQDTK

SEQ ID NO: 333 - protein, 17 aa, Streptococcus pyogenes
EAVISELETTTPSTLVK

SEQ ID NO: 334 - protein, 20 aa, Streptococcus pyogenes
YVDIAPENNVDGGQPGGNIR

SEQ ID NO: 335 - protein, 20 aa, Streptococcus pyogenes
DIAPENNVDGGQPGGNIRTG

SEQ ID NO: 336 - protein, 13 aa, Streptococcus pyogenes
KGPEERPYTVTGK

SEQ ID NO: 337 - protein, 15 aa, Streptococcus pyogenes
EAAAPTQEELLTEIR

SEQ ID NO: 338 - protein, 12 aa, Streptococcus pyogenes
WYANPGDQVTIK

SEQ ID NO: 339 - protein, 18 aa, Streptococcus pyogenes
SVTEGSIASSTLLSGTVK

SEQ ID NO: 340 - protein, 28 aa, Streptococcus pyogenes
VGDQVTQGQQLVQYNTTTAQSAYDTAVR

SEQ ID NO: 341 - protein, 19 aa, Streptococcus pyogenes
QQLQDLNDAYADAQAEVNK

SEQ ID NO: 342 - protein, 19 aa, Streptococcus pyogenes
SSVSGTVVEVNNDIDPSSK

SEQ ID NO: 343 - protein, 17 aa, Streptococcus pyogenes
NSQTLVHVATEGQLQVK

SEQ ID NO: 344 - protein, 12 aa, Streptococcus pyogenes
GTLTEYDLANVK

SEQ ID NO: 345 - protein, 35 aa, Streptococcus pyogenes
ISYVSNYPTESNAGSTTPAGSTGAGSSTGATYDYK

SEQ ID NO: 346 - protein, 31 aa, Streptococcus pyogenes
SNYPTESNAGSTTPAGSTGAGSSTGATYDYK

SEQ ID NO: 347 - protein, 11 aa, Streptococcus pyogenes
IDIISPLNQLK

SEQ ID NO: 348 - protein, 12 aa, Streptococcus pyogenes
HYVWTYDDATGK

SEQ ID NO: 349 - protein, 19 aa, Streptococcus pyogenes
LGNADAQQQEIHKGVAVGD

SEQ ID NO: 350 - protein, 14 aa, Streptococcus pyogenes
GVAVGDIVIANPDK

SEQ ID NO: 351 - protein, 20 aa, Streptococcus pyogenes
INETSGPVDDTVTDLFSDKR

SEQ ID NO: 352 - protein, 20 aa, Streptococcus pyogenes
DVFTVAPERVDVIDDTAGLK

SEQ ID NO: 353 - protein, 11 aa, Streptococcus pyogenes
VDVIDDTAGLK

SEQ ID NO: 354 - protein, 14 aa, Streptococcus pyogenes
TEYDFDKAPADVLK

SEQ ID NO: 355 - protein, 11 aa, Streptococcus pyogenes
YDFDKAPADVL

SEQ ID NO: 356 - protein, 18 aa, Streptococcus pyogenes
IIPNGGTLTNLLGNAPEK

SEQ ID NO: 357 - protein, 39 aa, Streptococcus pyogenes
ADNAASDALEALADQTDALQSEEAEVVQSDNAASDAWEK

SEQ ID NO: 358 - protein, 9 aa, Streptococcus pyogenes
SGNLIFDKK

SEQ ID NO: 359 - protein, 17 aa, Streptococcus pyogenes
LTPVYGSSLEIASDVYR

SEQ ID NO: 360 - protein, 21 aa, Streptococcus pyogenes
SGIKGDRGETGPAGPAGPQGK

SEQ ID NO: 361 - protein, 14 aa, Streptococcus pyogenes
GETGPAGPAGPQGK

SEQ ID NO: 362 - protein, 21 aa, Streptococcus pyogenes
GPAGPQGEAGKPGEQGPAGPQ

SEQ ID NO: 363 - protein, 15 aa, Streptococcus pyogenes
GEAGKPGEQGPAGPQ

SEQ ID NO: 364 - protein, 9 aa, Streptococcus pyogenes
IDKDGLIPL

SEQ ID NO: 365 - protein, 14 aa, Streptococcus pyogenes
DGLIPLGISLEAAK

SEQ ID NO: 366 - protein, 14 aa, Streptococcus pyogenes
ESTTQPVEAPVQET

SEQ ID NO: 367 - protein, 14 aa, Streptococcus pyogenes
STTQPVEAPVQETQ

SEQ ID NO: 368 - protein, 18 aa, Streptococcus pyogenes
TDSPEETPSSESPVAPAL

SEQ ID NO: 369 - protein, 17 aa, Streptococcus pyogenes
DSPEETPSSESPVAPAL

SEQ ID NO: 370 - protein, 27 aa, Streptococcus pyogenes
SEETPSPSTPAAPETPEEPAAPSPSPE

SEQ ID NO: 371 - protein, 22 aa, Streptococcus pyogenes
APSEETPSPETPEEPAAPSQPA

SEQ ID NO: 372 - protein, 25 aa, Streptococcus pyogenes
APSEETPSPETPEEPAAPSQPAESE

SEQ ID NO: 373 - protein, 19 aa, Streptococcus pyogenes
EETPSPETPEEPAAPSQPA

SEQ ID NO: 374 - protein, 22 aa, Streptococcus pyogenes
EETPSPETPEEPAAPSQPAESE

SEQ ID NO: 375 - protein, 21 aa, Streptococcus pyogenes
TSPSPSTPAESETQTPPAVTK

SEQ ID NO: 376 - protein, 12 aa, Streptococcus pyogenes
VDGIPPISLTQK

SEQ ID NO: 377 - protein, 14 aa, Streptococcus pyogenes
TTATTSENWHHIDK

SEQ ID NO: 378 - protein, 11 aa, Streptococcus pyogenes
EEFKKEVEESR

SEQ ID NO: 379 - protein, 12 aa, Streptococcus pyogenes
LSEAQKETYKQK

SEQ ID NO: 380 - protein, 14 aa, Streptococcus pyogenes
LLFTYHSEYMTAVK

SEQ ID NO: 381 - protein, 23 aa, Streptococcus pyogenes
IKTAPDKDKLLFTYHSEYMTAVK

SEQ ID NO: 382 - protein, 29 aa, Streptococcus pyogenes
DSDKPSSAAEKPAASSLVSEQTVQQPTSK

SEQ ID NO: 383 - protein, 30 aa, Streptococcus pyogenes
DSDKPSSAAEKPAASSLVSEQTVQQPTSKR

SEQ ID NO: 384 - protein, 16 aa, Streptococcus pyogenes
SSDKKEEQEQSYSPNR

SEQ ID NO: 385 - protein, 11 aa, Streptococcus pyogenes
EEQEQSYSPNR

SEQ ID NO: 386 - protein, 11 aa, Streptococcus pyogenes
VDGIPPISLTQ

SEQ ID NO: 387 - protein, 10 aa, Streptococcus pyogenes
VDGIPPISLT

SEQ ID NO: 388 - protein, 14 aa, Streptococcus pyogenes
EAAKEEFKKEVEES

SEQ ID NO: 389 - protein, 9 aa, Streptococcus pyogenes
AAKEEFKKE

SEQ ID NO: 390 - protein, 21 aa, Streptococcus pyogenes
LSEAQKETYKQKIKTAPDKDK

SEQ ID NO: 391 - protein, 12 aa, Streptococcus pyogenes
EAQKETYKQKIK

SEQ ID NO: 392 - protein, 22 aa, Streptococcus pyogenes
EAQKETYKQKIKTAPDKDKLLF

SEQ ID NO: 393 - protein, 19 aa, Streptococcus pyogenes
KETYKQKIKTAPDKDKLLF

SEQ ID NO: 394 - protein, 7 aa, Streptococcus pyogenes
KETYKQK

SEQ ID NO: 395 - protein, 16 aa, Streptococcus pyogenes
KETYKQKIKTAPDKDK

SEQ ID NO: 396 - protein, 10 aa, Streptococcus pyogenes
TAPDKDKLLF

SEQ ID NO: 397 - protein, 12 aa, Streptococcus pyogenes
IKTAPDKDKLLF

SEQ ID NO: 398 - protein, 15 aa, Streptococcus pyogenes
ESTTQPVEAPVQETQ

SEQ ID NO: 399 - protein, 13 aa, Streptococcus pyogenes
STTQPVEAPVQET

SEQ ID NO: 400 - protein, 21 aa, Streptococcus pyogenes
SVTTDSPEETPSSESPVAPAL

SEQ ID NO: 401 - protein, 18 aa, Streptococcus pyogenes
DSPEETPSSESPVAPALS

SEQ ID NO: 402 - protein, 15 aa, Streptococcus pyogenes
DSPEETPSSESPVAP

SEQ ID NO: 403 - protein, 16 aa, Streptococcus pyogenes
EETPSSESPVAPALSE

SEQ ID NO: 404 - protein, 22 aa, Streptococcus pyogenes
SVTTDSPEETPSSESPVAPALS

SEQ ID NO: 405 - protein, 17 aa, Streptococcus pyogenes
LSEAPAQPAESEEPSVA

SEQ ID NO: 406 - protein, 16 aa, Streptococcus pyogenes
SEAPAQPAESEEPSVA

SEQ ID NO: 407 - protein, 15 aa, Streptococcus pyogenes
EAPAQPAESEEPSVA

SEQ ID NO: 408 - protein, 34 aa, Streptococcus pyogenes
SEETPSPSTPAAPETPEEPAAPSPSPESEEPSVA

SEQ ID NO: 409 - protein, 24 aa, Streptococcus pyogenes
EETPSPETPEEPAAPSQPAESEES

SEQ ID NO: 410 - protein, 27 aa, Streptococcus pyogenes
APSEETPSPETPEEPAAPSQPAESEES

SEQ ID NO: 411 - protein, 20 aa, Streptococcus pyogenes
TSPSPSTPAESETQTPPAVT

SEQ ID NO: 412 - protein, 12 aa, Streptococcus pyogenes
ETKTPQTPDDAE

SEQ ID NO: 413 - protein, 26 aa, Streptococcus pyogenes
TPQTPDDAEETIADDANDLAPQAPAK

SEQ ID NO: 414 - protein, 16 aa, Streptococcus pyogenes
IADDANDLAPQAPAKT

SEQ ID NO: 415 - protein, 17 aa, Streptococcus pyogenes
IADDANDLAPQAPAKTA

SEQ ID NO: 416 - protein, 15 aa, Streptococcus pyogenes
SGNAPSETKEPYRLE

SEQ ID NO: 417 - protein, 15 aa, Streptococcus pyogenes
NYAQAIIDAVNLGAK

SEQ ID NO: 418 - protein, 12 aa, Streptococcus pyogenes
TADQQDKEMPVL

SEQ ID NO: 419 - protein, 15 aa, Streptococcus pyogenes
IYDNQDKGFPIELPN

SEQ ID NO: 420 - protein, 17 aa, Streptococcus pyogenes
IYDNQDKGFPIELPNVD

SEQ ID NO: 421 - protein, 15 aa, Streptococcus pyogenes
DNQDKGFPIELPNVD

SEQ ID NO: 422 - protein, 20 aa, Streptococcus pyogenes
GLTADGNIKPDIAAPGQDIL

SEQ ID NO: 423 - protein, 21 aa, Streptococcus pyogenes
GLTADGNIKPDIAAPGQDILS

SEQ ID NO: 424 - protein, 17 aa, Streptococcus pyogenes
ADGNIKPDIAAPGQDIL

SEQ ID NO: 425 - protein, 13 aa, Streptococcus pyogenes
QVTIPIDVSQFSK

SEQ ID NO: 426 - protein, 17 aa, Streptococcus pyogenes
NNFTALTTESNPWTIIK

SEQ ID NO: 427 - protein, 13 aa, Streptococcus pyogenes
TTESNPWTIIKAV

SEQ ID NO: 428 - protein, 25 aa, Streptococcus pyogenes
EGVENIEDIESSEITETIFAGTFAK

SEQ ID NO: 429 - protein, 11 aa, Streptococcus pyogenes
QDDDSHYYIHR

SEQ ID NO: 430 - protein, 11 aa, Streptococcus pyogenes
NGDGNPREVIE

SEQ ID NO: 431 - protein, 13 aa, Streptococcus pyogenes
NGDGNPREVIEDL

SEQ ID NO: 432 - protein, 12 aa, Streptococcus pyogenes
GDGNPREVIEDL

SEQ ID NO: 433 - protein, 17 aa, Streptococcus pyogenes
EVIEDLAANNPAIQNIR

SEQ ID NO: 434 - protein, 10 aa, Streptococcus pyogenes
LENAMEVAGR

SEQ ID NO: 435 - protein, 12 aa, Streptococcus pyogenes
LKELQQDYDLAK

SEQ ID NO: 436 - protein, 7 aa, Streptococcus pyogenes
ESTSWDR

SEQ ID NO: 437 - protein, 18 aa, Streptococcus pyogenes
ELEEKKEALELAIDQASR

SEQ ID NO: 438 - protein, 12 aa, Streptococcus pyogenes
EALELAIDQASR

SEQ ID NO: 439 - protein, 11 aa, Streptococcus pyogenes
ATALEKELEEK

SEQ ID NO: 440 - protein, 15 aa, Streptococcus pyogenes
ALELAIDQASQDYNR

SEQ ID NO: 441 - protein, 8 aa, Streptococcus pyogenes
EKELETIT

SEQ ID NO: 442 - protein, 17 aa, Streptococcus pyogenes
LELDQLSSEKEQLTIEK

SEQ ID NO: 443 - protein, 10 aa, Streptococcus pyogenes
LELDQLSSEK

SEQ ID NO: 444 - protein, 17 aa, Streptococcus pyogenes
LELDQLSSEKEQLTIEK

SEQ ID NO: 445 - protein, 10 aa, Streptococcus pyogenes
SSEKEQLTIE

SEQ ID NO: 446 - protein, 7 aa, Streptococcus pyogenes
EQLTIEK

SEQ ID NO: 447 - protein, 16 aa, Streptococcus pyogenes
KQVEKDLANLTAELDK

SEQ ID NO: 448 - protein, 11 aa, Streptococcus pyogenes
DLANLTAELDK

SEQ ID NO: 449 - protein, 13 aa, Streptococcus pyogenes
DLANLTAELDKVK

SEQ ID NO: 450 - protein, 15 aa, Streptococcus pyogenes
AELDKVKEDKQISDA

SEQ ID NO: 451 - protein, 16 aa, Streptococcus pyogenes
AELDKVKEDKQISDAS

SEQ ID NO: 452 - protein, 16 aa, Streptococcus pyogenes
DLANLTAELDKVKEEK

SEQ ID NO: 453 - protein, 15 aa, Streptococcus pyogenes
AELDKVKEEKQISDA

SEQ ID NO: 454 - protein, 7 aa, Streptococcus pyogenes
ELETITR

SEQ ID NO: 455 - protein, 10 aa, Streptococcus pyogenes
ELQQDYDLAK

SEQ ID NO: 456 - protein, 13 aa, Streptococcus pyogenes
KEALELAIDQASR

SEQ ID NO: 457 - protein, 21 aa, Streptococcus pyogenes
ALELAIDQASQDYNRANVLEK

SEQ ID NO: 458 - protein, 23 aa, Streptococcus pyogenes
DLANLTAELDKVKEDKQISDASR

SEQ ID NO: 459 - protein, 28 aa, Streptococcus pyogenes
KQVEKDLANLTAELDKVKEDKQISDASR

SEQ ID NO: 460 - protein, 21 aa, Streptococcus pyogenes
KQVEKDLANLTAELDKVKEEK

SEQ ID NO: 461 - protein, 8 aa, Streptococcus pyogenes
QALEDQRK

SEQ ID NO: 462 - protein, 9 aa, Streptococcus pyogenes
AKQALEDQR

SEQ ID NO: 463 - protein, 15 aa, Streptococcus pyogenes
AKQALEDQRKDLETK

SEQ ID NO: 464 - protein, 27 aa, Streptococcus pyogenes
GANMFGYGAFDFNPNNAKKYSDEVAIR

SEQ ID NO: 465 - protein, 14 aa, Streptococcus pyogenes
SAEDSVSQALSDAK

SEQ ID NO: 466 - protein, 16 aa, Streptococcus pyogenes
QTQVSNDVVLNDGASK

SEQ ID NO: 467 - protein, 16 aa, Streptococcus pyogenes
DAELSIFSEGSGVIYR

SEQ ID NO: 468 - protein, 18 aa, Streptococcus pyogenes
DGNSAYVVTNNHVIDGAK

SEQ ID NO: 469 - protein, 18 aa, Streptococcus pyogenes
VVGELVGADTYSDLAVVK

SEQ ID NO: 470 - protein, 13 aa, Streptococcus pyogenes
LAQYDVITEIDGK

SEQ ID NO: 471 - protein, 10 aa, Streptococcus pyogenes
LLQKPLILAA

SEQ ID NO: 472 - protein, 10 aa, Streptococcus pyogenes
QSVQPGFDRR

SEQ ID NO: 473 - protein, 22 aa, Streptococcus pyogenes
DASVTEADAQMLSVTQDNEDGK

SEQ ID NO: 474 - protein, 18 aa, Streptococcus pyogenes
DQEYSYTIDANSGDIVEK

SEQ ID NO: 475 - protein, 17 aa, Streptococcus pyogenes
LTSLGFAENSLEEIPEK

SEQ ID NO: 476 - protein, 21 aa, Streptococcus pyogenes
TPTSPPSAATGIANLTDLLAK

SEQ ID NO: 477 - protein, 19 aa, Streptococcus pyogenes
AQTNQSANQEIDSTSNPFR

SEQ ID NO: 478 - protein, 13 aa, Streptococcus pyogenes
VVDGEEVTEYTTK

SEQ ID NO: 479 - protein, 16 aa, Streptococcus pyogenes
TTKDGNVIQIPAGNEE

SEQ ID NO: 480 - protein, 18 aa, Streptococcus pyogenes
DGNVIQIPAGNEEGMESK

SEQ ID NO: 481 - protein, 18 aa, Streptococcus pyogenes
IDRFDIVVAQEEENGQKK

SEQ ID NO: 482 - protein, 15 aa, Streptococcus pyogenes
EEVNQDPDFYIPLGK

SEQ ID NO: 483 - protein, 12 aa, Streptococcus pyogenes
LASEDVPVPYAR

SEQ ID NO: 484 - protein, 12 aa, Streptococcus pyogenes
VLEQAILPDVEK

SEQ ID NO: 485 - protein, 11 aa, Streptococcus pyogenes
SKLDDLGPNLK

SEQ ID NO: 486 - protein, 13 aa, Streptococcus pyogenes
YMTDVNSIEDLSK

SEQ ID NO: 487 - protein, 9 aa, Streptococcus pyogenes
KIVLPQVVR

SEQ ID NO: 488 - protein, 14 aa, Streptococcus pyogenes
KKMVTKEDALLVIL

SEQ ID NO: 489 - protein, 14 aa, Streptococcus pyogenes
MMLLVLLSFLGLTT

SEQ ID NO: 490 - protein, 16 aa, Streptococcus pyogenes
SLLMFPSGSRHSQEVK

SEQ ID NO: 491 - protein, 24 aa, Streptococcus pyogenes
SGMGGTGDVAILSTADRMNLMPFA

SEQ ID NO: 492 - protein, 16 aa, Streptococcus pyogenes
GSGYDYLVNDFNTALK

SEQ ID NO: 493 - protein, 16 aa, Streptococcus pyogenes
IVSDSSFAPFEFQNGK

SEQ ID NO: 494 - protein, 33 aa, Streptococcus pyogenes
IEIANPGFDAALNAVQSSQADGVIAGATITDAR

SEQ ID NO: 495 - protein, 18 aa, Streptococcus pyogenes
FETPLEGISTGEVGFAVK

SEQ ID NO: 496 - protein, 15 aa, Streptococcus pyogenes
MEDIIAALSSILSHK

SEQ ID NO: 497 - protein, 9 aa, Streptococcus pyogenes
RADDLKPVA

SEQ ID NO: 498 - protein, 21 aa, Streptococcus pyogenes
LGVTTNEGIASAANGLLSLNR

SEQ ID NO: 499 - protein, 22 aa, Streptococcus pyogenes
SVADLPNGTQIAVPNDATNESR

SEQ ID NO: 500 - protein, 16 aa, Streptococcus pyogenes
DVNLADAQDGFYNPEK

SEQ ID NO: 501 - protein, 17 aa, Streptococcus pyogenes
TYLDIMSPVGGGSVIQK

SEQ ID NO: 502 - protein, 28 aa, Streptococcus pyogenes
DVVAAAGLDTYQTLLDEAAAITDDNDAR

SEQ ID NO: 503 - protein, 22 aa, Streptococcus pyogenes
AQAYLTDNAVDIPVVALGGTPR

SEQ ID NO: 504 - protein, 15 aa, Streptococcus pyogenes
TGATVAGPVPLPTER

SEQ ID NO: 505 - protein, 18 aa, Streptococcus pyogenes
IIAQAGDEVDLTEQGELK

SEQ ID NO: 506 - protein, 14 aa, Streptococcus pyogenes
EIMDAANNTGASVK

SEQ ID NO: 507 - protein, 15 aa, Streptococcus pyogenes
AAGADFVGEDDLVAK

SEQ ID NO: 508 - protein, 12 aa, Streptococcus pyogenes
DYASIDAAPEER

SEQ ID NO: 509 - protein, 22 aa, Streptococcus pyogenes
DLLSEYDFPGDDLPVIQGSALK

SEQ ID NO: 510 - protein, 15 aa, Streptococcus pyogenes
VNDEIEIVGIKEETK

SEQ ID NO: 511 - protein, 16 aa, Streptococcus pyogenes
QLDEGLAGDNVGILLR

SEQ ID NO: 512 - protein, 15 aa, Streptococcus pyogenes
GQVIAKPSSINPHTK

SEQ ID NO: 513 - protein, 21 aa, Streptococcus pyogenes
VIQNTAGEPVNNDNYHSVYDK

SEQ ID NO: 514 - protein, 18 aa, Streptococcus pyogenes
ITVAGNPSADNGQGSVSK

SEQ ID NO: 515 - protein, 14 aa, Streptococcus pyogenes
ETVEFEGETYPLIR

SEQ ID NO: 516 - protein, 19 aa, Streptococcus pyogenes
TTEIPVPASADAGPAVAPK

SEQ ID NO: 517 - protein, 27 aa, Streptococcus pyogenes
AIEEEFGVTAAAPVAAAAAGGAEEAAK

SEQ ID NO: 518 - protein, 18 aa, Streptococcus pyogenes
VTSAASSTSQFVSEQTEK

SEQ ID NO: 519 - protein, 18 aa, Streptococcus pyogenes
DLTTDLLINESIVTTEAR

SEQ ID NO: 520 - protein, 11 aa, Streptococcus pyogenes
EDGNLGLIEAK

SEQ ID NO: 521 - protein, 19 aa, Streptococcus pyogenes
MQAPILEQLSQEIDEDELK

SEQ ID NO: 522 - protein, 19 aa, Streptococcus pyogenes
MQAPILEQLSQEIDEDELK

SEQ ID NO: 523 - protein, 20 aa, Streptococcus pyogenes
GKELADDAKEAVEGAVDAVK

SEQ ID NO: 524 - protein, 18 aa, Streptococcus pyogenes
ELADDAKEAVEGAVDAVK

SEQ ID NO: 525 - protein, 16 aa, Streptococcus pyogenes
AQLSDDVITAAEADIK

SEQ ID NO: 526 - protein, 15 aa, Streptococcus pyogenes
ADEQHFGAYQHNGGR

SEQ ID NO: 527 - protein, 11 aa, Streptococcus pyogenes
LSEYGLQLAEK

SEQ ID NO: 528 - protein, 13 aa, Streptococcus pyogenes
TADKYADKAVQMS

SEQ ID NO: 529 - protein, 22 aa, Streptococcus pyogenes
AKEHLGGDYVPSDKELKLPTAN

SEQ ID NO: 530 - protein, 15 aa, Streptococcus pyogenes
EVTVPANGKVTVRVT

SEQ ID NO: 531 - protein, 15 aa, Streptococcus pyogenes
ERQADGSFILPLDKA

SEQ ID NO: 532 - protein, 18 aa, Streptococcus pyogenes
SQKQPEVPQEAVPTPKAA

SEQ ID NO: 533 - protein, 14 aa, Streptococcus pyogenes
KQPEVPQEAVPTPK

SEQ ID NO: 534 - protein, 17 aa, Streptococcus pyogenes
AETTEVEPKTDISEAPT

SEQ ID NO: 535 - protein, 13 aa, Streptococcus pyogenes
WFGDDVATANIKS

SEQ ID NO: 536 - protein, 9 aa, Streptococcus pyogenes
LQEEFGRRF

SEQ ID NO: 537 - protein, 10 aa, Streptococcus pyogenes
DLQEEFGRRF

SEQ ID NO: 538 - protein, 11 aa, Streptococcus pyogenes
SDLQEEFGRRF

SEQ ID NO: 539 - protein, 13 aa, Streptococcus pyogenes
KGPEERPYTVTGK

SEQ ID NO: 540 - protein, 13 aa, Streptococcus pyogenes
IAPANIIDNDGLR

SEQ ID NO: 541 - protein, 19 aa, Streptococcus pyogenes
VQVGDVLTISGEVEEFFGR

SEQ ID NO: 542 - protein, 21 aa, Streptococcus pyogenes
EAAAPTQEELLTEIRDLLAQK

SEQ ID NO: 543 - protein, 10 aa, Streptococcus pyogenes
FLDDDSFISQ

SEQ ID NO: 544 - protein, 17 aa, Streptococcus pyogenes
GAQGPKGDRGEQGIQGK

SEQ ID NO: 545 - protein, 18 aa, Streptococcus pyogenes
DGLIPLGISLEAAKEEFK

SEQ ID NO: 546 - protein, 13 aa, Streptococcus pyogenes
TKTPQTPDDAEET

SEQ ID NO: 547 - protein, 12 aa, Streptococcus pyogenes
NTVTEDTPATEQ

SEQ ID NO: 548 - protein, 20 aa, Streptococcus pyogenes
EAPSSKETKTPQTPDDAETT

SEQ ID NO: 549 - protein, 14 aa, Streptococcus pyogenes
QYETQYPDMTPSER

SEQ ID NO: 550 - protein, 18 aa, Streptococcus pyogenes
GILSGNAPSETKEPYRLE

SEQ ID NO: 551 - protein, 13 aa, Streptococcus pyogenes
EKELEEKKKALEL

SEQ ID NO: 552 - protein, 15 aa, Streptococcus pyogenes
LEDQRKDLETKLKEL

SEQ ID NO: 553 - protein, 12 aa, Streptococcus pyogenes
AIDQASRDYHRA

SEQ ID NO: 554 - protein, 20 aa, Streptococcus pyogenes
QVEKDLANLTAELDKVKEEK

SEQ ID NO: 555 - protein, 16 aa, Streptococcus pyogenes
TRLISVSQAMGLVTPR

SEQ ID NO: 556 - protein, 29 aa, Streptococcus pyogenes
ISSTPTGSNGNSGAVEGIGFAIPSTDVIK

SEQ ID NO: 557 - protein, 19 aa, Streptococcus pyogenes
DGNSAYVVTNNHVIDGAKR

SEQ ID NO: 558 - protein, 21 aa, Streptococcus pyogenes
TFTQTNAQQVAGAQYASDQAK

SEQ ID NO: 559 - protein, 19 aa, Streptococcus pyogenes
SANDDSDDELETPPFFKNR

SEQ ID NO: 560 - protein, 19 aa, Streptococcus pyogenes
KRGNFAIEGIEELREQVDT

SEQ ID NO: 561 - protein, 29 aa, Streptococcus pyogenes
SKLKNSAFATLPDLEAALKALEGSAYYDK

SEQ ID NO: 562 - protein, 10 aa, Streptococcus pyogenes
AVYEIEFQNK

SEQ ID NO: 563 - protein, 8 aa, Streptococcus pyogenes
EHFIMKFK

SEQ ID NO: 564 - protein, 14 aa, Streptococcus pyogenes
QIPLVNEIYTPTKK

SEQ ID NO: 565 - protein, 17 aa, Streptococcus pyogenes
AIVMLVAENAMQAEAIK

SEQ ID NO: 566 - protein, 12 aa, Streptococcus pyogenes
EGTDLTIVSYGR

SEQ ID NO: 567 - protein, 18 aa, Streptococcus pyogenes
SFHESVNMAATWKLPVIF

SEQ ID NO: 568 - protein, 25 aa, Streptococcus pyogenes
TTEDLEAAGLEVPKAPAQAASAAPK

SEQ ID NO: 569 - protein, 16 aa, Streptococcus pyogenes
QLSDGAYVVFPDGAVK

SEQ ID NO: 570 - protein, 24 aa, Streptococcus pyogenes
YKSVADLPNGTQIAVPNDATNESR

SEQ ID NO: 571 - protein, 21 aa, Streptococcus pyogenes
LPSSVNQPKDYASIDAAPEER

SEQ ID NO: 572 - protein, 19 aa, Streptococcus pyogenes
DTDKPLLLPVEDVFSITGR

SEQ ID NO: 573 - protein, 11 aa, Streptococcus pyogenes
DFPGDDLPVIQ

SEQ ID NO: 574 - protein, 18 aa, Streptococcus pyogenes
DTVDSYIPEPERDTDKPL

SEQ ID NO: 575 - protein, 19 aa, Streptococcus pyogenes
LRGVQRDEIERGQVIAKPS

SEQ ID NO: 576 - protein, 20 aa, Streptococcus pyogenes
SYIPEPERDTDKPLLLPVED

SEQ ID NO: 577 - protein, 17 aa, Streptococcus pyogenes
ASKETVEFEGETYPLIR

SEQ ID NO: 578 - protein, 14 aa, Streptococcus pyogenes
VEISSDSHPFYTGR

SEQ ID NO: 579 - protein, 13 aa, Streptococcus pyogenes
EEKETVDFWGITN

SEQ ID NO: 580 - protein, 12 aa, Streptococcus pyogenes
ALNIENIIAEIK

SEQ ID NO: 581 - protein, 12 aa, Streptococcus pyogenes
EGVAAAEAEEIK

SEQ ID NO: 582 - protein, 349 aa, Streptococcus pyogenes
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 583 - protein, 475 aa, Streptococcus pyogenes
MAAACSQTTLTALKIKQYLRQFNALFKGYLRIELIKSRIYCEVLNDKREAFFYDIFALSDTLKMLTFLLLDNPKHKSIAVYTRKQGISQSKAYRLIHKLKHYLQDIGLNIVDNTVIGDELKIRYLIALLHKEYGIILYDIQPADIETIHAFIFAAQKNLQPSAFLDRRFLFFDVLLMLTWKRHRYPVHLPHLALFEHLKSLPIFDNIKTIAVDELAPRTRVTFSSDDFDYLFLIYLTTDNSFLSGYWTSHQRQQLYHLITKDPDYHLLIHRLQALVGKYSDIHEHIPNLIPFFKRTLYNLQTLITFDGYYFDQYQGNMLLLDKLETVIKDWLYDTGRQGSISSGHLHLMCLYLEQILESSIAPINITVIESQETVGNVIANFITSTIPSYKVKLSRVNILSDNIYPYDKPVDLVVTSQKLLPFLKELGVFPKETRLFGLSLDCIQQQREDLIKTILALHQNHYQKRLEELWRVPS

SEQ ID NO: 584 - protein, 310 aa, Streptococcus pyogenes
MPTLPKASSAITLINLDQLTEHDQEALVSEGLIDAEVFDYAKDKNETSFMEENKEKLTIVFQILDRQEESYHPNHIPRVIPITLFLNDQSLYILGHDHSLTLIEEVFPDLDESRSPRHLVFQLLTAFTKQYVPLMDEIAQQRDKLIEALRQKANKTNLESLANLQSGTVYILMGSKQNEQMLAELKDMPGQQDLEEDEAEQLRDAIIEARQLSNMCDLNTRVLKEISSSYNNVLSNNLNNNVTSLTIFSIGISIIAMVTSFYGMNVKLPFAKVDSVWFWIVLTTSLVALLIMVVMYWYVHKRNRNASKRI

SEQ ID NO: 585 - protein, 349 aa, Streptococcus pyogenes; identical to SEQ ID NO: 582

SEQ ID NO: 586 - protein, 502 aa, Streptococcus pyogenes
MLDYYLESDIIDQKILLAILLTEKELTMAAACSQTTLTALKIKQYLRQFNALFKGYLRIELIKSRIYCEVLNDKREAFFYDIFALSDTLKMLTFLLLDNPKHKSIAVYTRKQGISQSKAYRLIHKLKHYLQDIGLNIVDNTVIGDELKIRYLIALLHKEYGIILYDIQPADIETIHAFIFAAQKNLQPSAFLDRRFLFFDVLLMLTWKRHRYPVHLPHLALFEHLKSLPIFDNIKTIAVDELAPRTRVTFSSDDFDYLFLIYLTTDNSFLSGYWTSHQRQQLYHLITKDPDYHLLIHRLQALVGKYSDIHEHIPNLIPFFKRTLYNLQTLITFDGYYFDQYQGNMLLLDKLETVIKDWLYDTGRQGSISSGHLHLMCLYLEQILESSIAPINITVIESQETVGNVIANFITSTIPSYKVKLSRVNILSDNIYPYDKPVDLVVTSQKLLPFLKELGVFPKETRLFGLSLDCIQQQREDLIKTILALHQNHYQKRLEELWRVPS

SEQ ID NO: 587 - protein, 751 aa, Streptococcus pyogenes
MKKWQKYVLDYVVRDRRTPVENRVRVGQNMMLLTIFIFFIFIINFMIIIGTDQKFGVSLSEGAKKVYQETVTIQAKRGTIYDRNGTAIAVDSTTYSIYAILDKSFVSASDEKLYVQPSQYETVADILKKHLGMKKTDVIKQLKRKGLFQVSFGPSGSGISYSTMSTIQKAMEDAKIKGIAFTTSPGRMYPNGTFASEFIGLASLTEDKKTGVKSLVGKTGLEASFDKILSGQDGVITYQKDRNGTTLLGTGKTVKKAIDGKDIYTTLSEPIQTFLETQMDVFQAKSNGQLASATLVNAKTGEILATTQRPTYNADTLKGLENTNYKWYSALHQGNFEPGSTMKVMTLAAAIDDKVFNPNETFSNANGLTIADATIQDWSINEGISTGQYMNYAQGFAFSSNVGMTKLEQKMGNAKWMNYLTKFRFGFPTRFGLKDEDAGIFPSDNIVTQAMSAFGQGISVTQIQMLRAFTAISNNGEMLEPQFISQIYDPNTASFRTANKEIVGKPVSKKAASETRQYMIGVGTDPEFGTLYSKTFGPIIKVGDLPVAVKSGTAQIGSEDGSGYQDGGLTNYVYSVVAMVPADKPDFLMYVTMTKPQHFGPLFWQDVVNPVLEEAYLMQDTLTKPVVSDANRQTTYKLPNFVGKNPGETSSELRRNLVQPVVLGTGSKIKKVSHQPGQTLTENQQVLILSDRFVEVPDMYGWTKSNVKTFAKWTGIDISFKGTDSGRVMKQSVDVGKSLKKIKKMTITLGD

SEQ ID NO: 588 - protein, 339 aa, Streptococcus pyogenes
MRKRCYSTSAAVLAAVTLFVLSVDRGVIADSFSANQEIRYSEVTPYHVTSVWTKGVTPPANFTQGEDVFHAPYVANQGWYDITKTFNGKDDLLCGAATAGNMLHWWFDQNKDQIKRYLEEHPEKQKINFNGEQMFDVKEAIDTKNHQLDSKLFEYFKEKAFPYLSTKHLGVFPDHVIDMFINGYRLSLTNHGPTPVKEGSKDPRGGIFDAVFTRGDQSKLLTSRHDFKEKNLKEISDLIKKELTEGKALGLSHTYANVRINHVINLWGADFDSNGNLKAIYVTDSDSNASIGMKKYFVGVNSAGKVAISAKEIKEDNIGAQVLGLFTLSTGQDSWNQTN

SEQ ID NO: 589 - protein, 871 aa, Streptococcus pyogenes
ADELSTMSEPTITNHAQQQAQHLTNTELSSAESKSQDTSQITLKANREKEQSQDLVSEPTTTELADTDAASMANTGSDATQKSASLPPVNTDVHDWVKTKGAWDKGYKGQGKVVAVIDTGIDPAHQSMRISDVSTAKVKSKEDMLARQKAAGINYGSWINDKVVFAHNYVENSDNIKENQFEDFDEDWENFEFDAEAEPKAIKKHKIYRPQSTQAPKETVIKTEETDGSHDIDWTQTDDDTKYESHGMHVTGIVAGNSKEAAATGERFLGIAPEAQVMFMRVFANDIMGSAESLFIKAIEDAVALGADVINLSLGTANGAQLSGSKPLMEAIEKAKKAGVSVVVAAGNERVYGSDHDDPLATNPDYGLVGSPSTGRTPTSVAAINSKWVIQRLMTVKELENRADLNHGKAIYSESVDFKDIKDSLGYDKSHQFAYVKESTDAGYNAQDVKGKIALIERDPNKTYDEMIALAKKHGALGVLIFNNKPGQSNRSMRLTANGMGIPSAFISHEFGKAMSQLNGNGTGSLEFDSVVSKAPSQKGNEMNHFSNWGLTSDGYLKPDITAPGGDIYSTYNDNHYGSQTGTSMASPQIAGASLLVKQYLEKTQPNLPKEKIADIVKNLLMSNAQIHVNPETKTTTSPRQQGAGLLNIDGAVTSGLYVTGKDNYGSISLGNITDTMTFDVTVHNLSNKDKTLRYDTELLTDHVDPQKGRFTLTSHSLKTYQGGEVTVPANGKVTVRVTMDVSQFTKELTKQMPNGYYLEGFVRFRDSQDDQLNRVNIPFVGFKGQFENLAVAEESIYRLKSQGKTGFYFDESGPKDDIYVGKHFTGLVTLGSETNVSTKTISDNGLHTLGTFKNADGKFILEKMPKETLS

SEQ ID NO: 590 - protein, 757 aa, Streptococcus pyogenes; identical to SEQ ID NO: 5

SEQ ID NO: 591 - protein, 61 aa, Streptococcus pyogenes
GFNLASGVVLYWTVSNAFQVVQLLLLNNPFKIIAERQRLANEEKERRLRERRARKKAMKRK

SEQ ID NO: 592 - protein, 75 aa, Streptococcus pyogenes
WLVGGFFSIIQQLITTYLLKPRLHKQIKEEYAKNPPKAYQSTSSRKDVTPSQNMEQANLPKKIKSNRNAGKQRKR

SEQ ID NO: 593 - protein, 78 aa, Streptococcus pyogenes
SNVFVYYRDLAQVWEVLLQAGMYATPIIYPITFVLDSHPLAAKLLMLNPVAQMIQDFRYLLIDRANVTIWQMSTNWFY

SEQ ID NO: 594 - protein, 202 aa, Streptococcus pyogenes
PKVGKFEKQLLVSSLQQAQSNMERTHTLAAGDANALSDVGIIGDSVALRSSAAFSQIMPQAQLDAAVSRNFKEAFDLFNNQIKSKSLSKTVVLAVGVNSLDNYSQAVQSFIEALPKGHRLVLVSPYNAKNASQVAEARDYGLKLSKKYKYVTIADWYKVAVEHPDIWYGSDGVHYSEDSQGAELYVSTIQTAVEKSAKKPAK

SEQ ID NO: 595 - protein, 395 aa, Streptococcus pyogenes
AISQMKKLAMVFEKDYLDLVLKTLQQSQLVEVRDMKQLKHWQDAFNKGNVKLPQIVQYDLTHQKPLLDDEALQYLLQSQQELENGLASLSAFLPPIGKLTALRQKTPSLSFKQFEERHRQQAAQTALKMMSQKIERLEQLQSKIDQLTEYCQELEKWRSLTVLPQDLAQFHFLSARVGTIPSTANNHFYHQLKQHKGLFIEEVYHTEFEYGLVLFWQAQDTIHLQKYQFKPLLYKEQLLPSEQLRINKELLTNWLAEKDSLLKELRQSQKILAQLQVEIDYVLSQYQRQQTKKQLLGTRHLIALEGWIEADSVNQLKGLMTKTLGDMFYLDSYDVTPDDWEDVPIKLRNHRYIAPFELVTEMYALPKYQEKDPTPFLAPLYLTFFGMMVADLGYG

SEQ ID NO: 596 - protein, 262 aa, Streptococcus pyogenes
TSGMADKGETVNIAYVQWDSEVASTHVIAEVLKNEGYHVTLTPLDNAVMWQTVANGNADFSTSAWLPVTHGQQYQKYKSKLDDLGPNLKGTKLGLAVPKYMTDVNSIEDLSKQADQKITGIEPGAGIMAAAQKTLKEYHNLSSWELVAASTGAMTTSLDQAIKKKDPIVVTAWSPHWMFAKYDLKYLKDPKEIFGSTENINTIARKGLKKELPNVYKIIDKFHWTQKDMEAVMLDINKGMSPEAAAKKWVEANKSKVSSWTK

SEQ ID NO: 597 - protein, 66 aa, Streptococcus pyogenes
TTMAVCCPLAITLCQKADKHPLIGAQAVNWGASGGANLITSGSGIVFQGLFKQMGWEEQAFSLGNH

SEQ ID NO: 598 - protein, 99 aa, Streptococcus pyogenes
ILLFRRFILDDTVIKTISYYYFPFRVNRLNFYSNASGIWTFSNWCSSYLSSWRYVWITSKSNARPVVAIGDSDIYSYRLWSFFCQWINTIFCWSNRRRP

SEQ ID NO: 599 - protein, 275 aa, Streptococcus pyogenes
QANQYLRVGMEAAYAPFNWTQDDASNGAVPIEGTSQYANGYDVQVAKKVAKAMNKELLVVKTSWTGLIPALTSGKIDMIAAGMSPTKERRNEISFSNSSYTSQPVLVVTANGKYADATSLKDFSGAKVTAQQGVWHVNLLTQLKGAKLQTPMGDFSQMRQALTSGVIDAYISERPEAMTAEAADSRLKMITLKKGFAVAESDAAIAVGMKKNDDRMATVNQVLEGFSQTDRMALMDDMVTKQPVEKKAEDAKASFLGQMWAIFKGNWKQFLRGTG

SEQ ID NO: 600 - protein, 219 aa, Streptococcus pyogenes
ADVDYSITNYEGQLLLSKENTARFEQKVTYQFDTSYNGQYISLGRTGHLPAGFAIDQKPKVEVYQNGQQVPVSQEFSDLGDGYRLKLYNAGQAGDKVDVKVIWQLHHLLTAYQDVAELNWTPISDWDKTLEKVSLTVTTPTDIQDSNLWAHRGYYQKKPQVLKEGNSRYQINAKNVSGQLELHAYWDKKALLGKEPVDVSTSKKNKIVALETKISRRRT

SEQ ID NO: 601 - protein, 253 aa, Streptococcus pyogenes
PTSLIFKQDPNYNKMTTTPDKKVAYENLTFQRMGYVNYFSSKELKDNASKVDSSVTTEATSANKAIYEKYIDSLGNGWQLKRFPTSKQFYAIRNIPIYERVWNFFSNLVVIDHPWKIQDKDNPKLARYIRLEKDKSVGWSLVGSGTKHKYLLYTNGKFPYLHQNFVTLNLGTSYPTYSNIPVLQVISQGQGRTALQDVTFPSGVTKKSSVDIYSRSYKNPKSLDDITKVNYGKGDSYTKTINNYVDPSMIHNS

SEQ ID NO: 602 - protein, 51 aa, Streptococcus pyogenes
YPMFANYDFNDVSNINDFSKRYIWPNAEYWFGTDKNGQSLFDGVWYGARNS

SEQ ID NO: 603 - protein, 67 aa, Streptococcus pyogenes
RTTLGATAALVPLTFATFPFYARQVQVVFSELDKGVIEAAQASGATFWDIVKVYLSEGLPDLIRVST

SEQ ID NO: 604 - protein, 70 aa, Streptococcus pyogenes
QHIPSLEGWTFEQIAFIYGFCLIPKGIDHLFFDNLWALGQRLVRKGEFDKYLTRPISPLFHVLVETFQVD

SEQ ID NO: 605 - protein, 70 aa, Streptococcus pyogenes
DDNILKDNAQPVHFHDYSHESLPKRIYLALVHAIDEFFDTGRYLVFGTLIASAMQIYVPTRVLTTIGHNP

SEQ ID NO: 606 - protein, 89 aa, Streptococcus pyogenes
RFFTTAIKGAHGWIVIGPVSFQPAEYLKIIMVWYLALTFAKIQKNISLYDYQALTRRKWWPTQWNDLRDWRVYSLLMVLLVAAQPDLGN

SEQ ID NO: 607 - protein, 77 aa, Streptococcus pyogenes
GVERVAKIPVFGYVAKRFSAFFNPFHDLTDSGHQLANSYYAMSNGGWFGQGLGNSIEKRGYLPEAQTDFVFSVVIEE

SEQ ID NO: 608 - protein, 140 aa, Streptococcus pyogenes
NIQRVASGVENNVHINTYLQVDSTDAAKVIQNTAGEPVNNDNYHSVYDKIAQIKGVKKITFSSKDEQLKKLQETLGDVWNMYDQDTNPLQDIYLIETQTPKQVKAITKKIRTIEGVEAADYGGINSDKLFKFSTLIQTWG

SEQ ID NO: 609 - protein, 183 aa, Streptococcus pyogenes
KDADATLTLSQVSRAQENQITADKVAPLAQLNTVAWSVKNPKDADKVKVSLFGIDSNSFIRPNIVKGRLFKTNKEVVLDQSLAKEEAFAIGKDFYTSSSSQALTIVGYTQNARFSVAPVVYMNLEAFETLKYGEPLPKDKQVVNAFITKGSLTDYPKKDFQKLDIKTFITKLPGYSAQLLTFG

SEQ ID NO: 610 - protein, 431 aa, Streptococcus pyogenes
SYEKEGKILSGLPIISALNNDNDINWLGFSTNARYKSLAYVWTRQVTKKIMEKPTNYSQETIASIAQKYQKLAEDINKDRKNNIADQTVIYLLSESLSDPDRVSNVTVSHDVLPNIKAIKNSTTAGLMQSDSYGGGTANMEFQTLTSLPFYNFSSSVSVLYSEVFPKMAKPHTISEFYQGKNRIAMHPASANNFNRKTVYSNLGFSKFLALSGSKDKFKNIENVGLLTSDKTVYNNILSLINPSESQFFSVITMQNHIPWSSDYPEEIVAEGKNFTEEENHNLTSYARLLSFTDKETRAFLEKLTQINKPITVVFYGDHLPGLYPDSAFNKHIENKYLTDYFIWSNGTNEKKNHPLINSSDFTAALFEHTDSKVSPYYALLTEVLNKASVDKSPDSPEVKAIQNDLKNIQYDVTIGKGYLLKHKTFFKISR

SEQ ID NO: 611 - protein, 56 aa, Streptococcus pyogenes
TKTDSYKSTIVFLVCFYRSTDAFSDLYQGMFQQHERLDIAGKSLAYRNTLIFMVYT

SEQ ID NO: 612 - protein, 84 aa, Streptococcus pyogenes
SPINDIPDEYVHYSRTVYISEGDINLTNNNKKLRISKDVDKLIKQSGKTFITSNLKATKHSTREYSYPYIKGTNAYYSFSYIPQ

SEQ ID NO: 613 - protein, 245 aa, Streptococcus pyogenes
GLGNAMKNSVTSTFSSKQKDIQLYFQEKGEEEDLYAGLHTHENNHEVKPEWLEQIVKDIDGIDSYYFTNSATSTISYEKKKVDNASIIGVSKDYFNIKNYDIVAGRTLTDNDYSNFSRIILLDTVLADDLFGKGNYKSALNKVVSLSDKDYLVIGVYKTDQTPVSFDGLSGGAVMANTQVASEFGTKEIGSIYIHVNDIQNSMNLGNQAADMLTNISHIKDGQYAVPDNSKIVEEINSQFSIMTT

SEQ ID NO: 614 - protein, 261 aa, Streptococcus pyogenes
ERLTFFDTSHSKTVIAHRGLVSAGVENSLEALEGAKKAGSDYVELDLILTKDNHFVVSHDNRLKRLAGVNKTIRNLTLKEVEHLTSHQGHFSGRFVSFDTFYQKAKKLNMPLLIELKPIGTEPGNYVDLFLETYHRLGISKDNKVMSLDLEVIEAIKKKNPSITTGYIIPIQFGFFGDEFVDFYVIEDFSYRSYLSSQAFWNNKEIYVWTINDPKRIEHYLLKPIQGIITDQPALTNQLIKDLKQDNSYFSRLVRIISSLY

SEQ ID NO: 615 - protein, 191 aa, Streptococcus pyogenes
TPEIRAGLEKFGRSTQVFLQKQYVSSESALVDALIKSVAYMGPRKIGALIAIEQTQTLQEYIATGIPLNADISSQLLINIFIPNTPLHDGAVIVGQNKIVAACAYLPLSESKAISKEFGTRHRAAIGLSENSDALTIIVSEETGAISVTRKGQFLHDLSTDEFETVLRTYLMSNSNVTLPWYKKILGGKSK

SEQ ID NO: 616 - protein, 58 aa, Streptococcus pyogenes
HGLRCWQKKQWLPATFSFVGTTNDWSKIGYPLLLALFEETIYRFLWFNILAFQWHLPT

SEQ ID NO: 617 - protein, 143 aa, Streptococcus pyogenes
KSSFNTATTVPKLTIRYQLEGEKTDYQKNFLAFLKVLNQKLHLETKPSNSLEKDRQRVSEGALTAVLEVKKNQTIKVITNNINQQNADLINMLVKNYVDNAKTYDSIAALYPQQLNHIRKRSVDYVKVSSIQTSKGMTSADYY

SEQ ID NO: 618 - protein, 149 aa, Streptococcus pyogenes
SFSNNNQAKIGILDKDNSQISKQFIAQLKQNKKYDIFTKIKKEHIDHYLQDKSLEAVLTIDKGFSDKVLQGKSQKLNIRSIANSEITEWVKAQTNYLLENYNIIGDVALGNEDTFNRILQKNQQLNYDVKQVTLTDRSRSKAVSSTTTG

SEQ ID NO: 619 - protein, 425 aa, Streptococcus pyogenes
YTKLDWGYRGLKQRINHLVDLSAPYLSDDDAILEVLKDSTSTTYHLVQYLERSRGNFPIYNNTRVTYFPTGETFFDSLKEQLFLAKKYIFLEFFIIAEGQMWGEILSILEKKVSEGVEVRVLFDGMNELSTLSSDYAKRLEQIGIKAKSFLPISPFISTYYNYRDHRKIVVIDGEVSFTGGINLADEYINEVERFGHWKDAGLMLEGEATDSFLILFLQMWSITEKELIIDPYLSDHSLKLPSDGYVIPYGDSPLDTDKIGKNVYIDILNHAKEYVYIMTPYLILDSEMEHALRFASERGVDIRIIMPGVPDKGVPYALAKTYYKALMSSGVKIYEYQPGFVHSKVFISDNTKAVVGTINLDYRSLYHHFECATYLYRVSVIADIVNDFNEAQKQSLLMTSDHLTQRPWYQKLIGLLVRIIAPLL

SEQ ID NO: 620 - protein, 125 aa, Streptococcus pyogenes
HYANMTTYPLERIVTKSLSPITDKTYQALTQGKIEKDTFQGQSLIRRDGELVLAVLPTKVDLEQLASESTRQIIVTKKEWRFVTPDGKELRAHVRGQQQSLADLTTVKAVKDFVNQQWYDSNKAS

SEQ ID NO: 621 - protein, 150 aa, Streptococcus pyogenes
SCGNHLVGQFWSYIIPSKDALKLWGDALTAPIVEEPIKASSAILVITLFPRLTLKEKLVVALLSGMGFQLTEDIRYLIQAKSIDSLVPTAIERISTAVTSHWVHTAIFTIGAYLLLKGSNLFSKQQQIFWLLSPLVLHFIWNSPLTSIPG

SEQ ID NO: 622 - protein, 75 aa, Streptococcus pyogenes
TKGTSLAFNAGIVEMFAQAQILGGSDYRYFERYISVALVYWSISILMEQVGRLIENKMAIKAPEQARNEKLGELR

SEQ ID NO: 623 - protein, 105 aa, Streptococcus pyogenes
MENGFDSSKNVMIISKDYQAIREYITTVMDRGVTKLPIRGGYTTSDKIMLMAIVSSHELPTLQEKILEIDDTAFIVVMPAAQVMGRGFSLTKQYKREDKDVLLPM

SEQ ID NO: 624 - protein, 69 aa, Streptococcus pyogenes
PDLITSISTLTKFDTITIQEVVNNLEHNKLLARTIQYIGGDGKLTETIANYSQQLLKQFLTVLTNILTS

SEQ ID NO: 625 - protein, 283 aa, Streptococcus pyogenes
PMALSQFSKGKDTVVIAGKLGAEPDILINLYKELIEDQSDISVELKSNFGKTSFLYEALKSGDIDMYPEFTGTITSSLLRDKPPLSNDPKQVYEDAKKGIAKQDKLTLLKPFAYQNTYAVAMPEKLAKEYQIETISDLKAHADTLKAGFTLEFKDRADGYKGMQSQYGLQLSVATMEPALRYQAIQSGDIQVTDAYSTDAEITKYHLKVLKDDKQLFPPYQGAPLMKTSLLTKHPELKGILNQLAGKITEKEMQDMNYEVSVKGADANKVARDYLLKTGLIQK

SEQ ID NO: 626 - protein, 298 aa, Streptococcus pyogenes
GQLTTFLNVVVQYTKPFNDISSVLAEIQSSLACAQRLYDLLDIEIKEQEHFLTFKASAVKGQIDFEEVSFSYQKDRPLLKDINFSVPAGSKVAIVGPTGAGKSTLINLLMRFYELDAGSIKLDKVPIKCYAKEELRSITGIVLQETWLKDATVHELIAYGSEEASRDEVVAAAKAAHAHFFIMQLPKTYDTYLSASDDALSQGQLQLLAIARMFLKKPKVLVLDEATSSIDIRTEAVIQEALKELMRGRTSFIIAHRLSTIQSADLILVMDQGRLVEWGTHASLMSKNGCYVRLQKIE

SEQ ID NO: 627 - protein, 55 aa, Streptococcus pyogenes
SLFLMFLSSTIYHSMAYGSVHKYILRIIDHSMIYIAIAGSYTPVALSLVSGWLGY

SEQ ID NO: 628 - protein, 117 aa, Streptococcus pyogenes
TVFNLPQMTRNVEDSLLHVHHTQREAGLALGLSRWETVFYVVIPEALPGMVTGIVLASGRIFGEAAALIYTAGQSAPALDWSNWNPLSVTSPISIFRQSETLAVHIWKVNSEGTIPD

SEQ ID NO: 629 - protein, 179 aa, Streptococcus pyogenes
YMGPQDQQIRYYHQKVESDLKGILYRFESFLLEGKGQNEGLLIKNLDKILDEALKLVYRERHNQLFQQTNYQVHYFEMRRQQNRLLGQMAINVNTLMRQSKESILLSHLFHETACQLSEQNPALTLIDDIEQLLETFRHGDLPQTREEFERRAVLFQLLQDLERFILLKVEFYQDYQND

SEQ ID NO: 630 - protein, 311 aa, Streptococcus pyogenes
KVTGPDMERTASRYLERHQVMDLTVLASHQFSQADKQELDTLKGAHLEYGHLLDVSLTSNQKSLRLYSVPKKVSKPVLVKGSWPKRETDLVLSSSLAKNYQIGDELAVTSPMEGLLTTTHFQVVGFANSSEVWSKSNLGSSSTGDGSLYAYAFVNPNVFKSAFNLLRIRFSHLRLTNAFSKDYQKRVTQNQAHLDNLLKDNGQKRYDDLQNQYDLALKNGRAALAKETVKLAASEENLTFLEGSALQEAKHQIEQGKQALAKEEKQLEQVQATKDKLEKPSYLTYNRSTLPGGEGYHTYATSTTSISNVGN

SEQ ID NO: 631 - protein, 212 aa, Streptococcus pyogenes
QSSLAKVVEHQFGDLTTYDILAVGSAKATATEQTDLASYLKQEPITGYQKVSYASLTLPVKGLPDKQSISILSSSATSLSPYFNLLDSQEQKKVPIPTSGVLISEKLASYYKVKPGDQLVLTDRKGQSYKVTIKQVIDMTVGHYLIMSDTYFKNHFKGLEAAPAYLIKVKDKDSKHIKETASDLLTLKAIRAVSQNVNHIKSVQLVVTSLNQ

SEQ ID NO: 632 - protein, 217 aa, Streptococcus pyogenes
KTAFDIFMESSFSLSDGFDSRHLKKYEKAILEIPKIVAVKSQRARTYGSNVYLDIVLEMNPDLSVYESHSITEKVEQLLSDQFSIYDIDIHVEPAMIPEEEIFDNVAKKLYRYEKLILSKVPDYDHYIAKSFQLIDANGQTVNYEQFLNQEIYYPSNFNHFQIESISQKTMLVTYQLNGNQRTSIWRRHESWSLLFHQITPIAKKQLHHTHYRIVKM

SEQ ID NO: 633 - protein, 59 aa, Streptococcus pyogenes
EMRDGTLQEVRLPDFIRFMIFFPTFSSGPIDRFRHFQEDYHKLPERDDYFAMLNKAVMY

SEQ ID NO: 634 - protein, 73 aa, Streptococcus pyogenes
GIRTPENFNMPFLSASLKDFWNRWHMSLSFWFRDYVFMRLVHLLIKHKTFKNRNVTSGVAYLVNMLVMGFWHG

SEQ ID NO: 635 - protein, 506 aa, Streptococcus pyogenes
SAETIAIVSDTAYAPFEFKDSDQIYKGIDVDIINEVAKRQSWDFSMSFPGFDAAVNAVQSGQASALMAGTTITNARKKVFHFSEPYYDTKIVIATRKANAIKKYSDLKGKTVGVKNGTAAQAFLNNYKKKYDYTVKTFDTGDLMYNSLSAGSIAAVMDDEAVIQYAISQNQDIAINMKGEPIGSFGFAVKKGSGYDYLVNDFNTALKAMKADGTYQAIMTKWLGTDDKATTSQATGNPSAKATPTKDSYKIVSDSSFAPFEFQNGKGKYVGIDIELIKAIAKQQGFKIEIANPGFDAALNAVQSSQADGVIAGATITDARKAIFDFSDPYYTSNIILAVKAGKNIKNYEDLDRKTVGAKNGTSSYSWLKENAPKYGYNVKAFDDGSSMYDSLNSGSVDAIMDDEAVLKYAISQGRRFETPLEGISTGEVGFAVKKGTNPELIEMFNNGLAALKKSGQYDDIIDKYLDSKKAATPSEKGADESTISGLLSNNYKQLLAGLGTTLSLT

SEQ ID NO: 636 - protein, 77 aa, Streptococcus pyogenes
NIDIADLLRLMKQNLPKDIFRPASAIVENIFSKPSGSVLGVATLTGLWTMSRSLTSLQKAINKAYGASQHRDFFIGH

SEQ ID NO: 637 - protein, 78 aa, Streptococcus pyogenes
KKGKDIQSIQQIIQDDISFSPWTQFWHGWLQLTTVSMGAPVGREGASREVAVTLTSLWSQRCNLSKADQKLLLACASG

SEQ ID NO: 638 - protein, 58 aa, Streptococcus pyogenes
TYWNDWFNALLYVQSENLYPMQYLLMKIQSNLQALAQNAGMSAQMADSLASLPKESVR

SEQ ID NO: 639 - protein, 127 aa, Streptococcus pyogenes
NHFSQVKKKNRFALIRFKEEKIEVNNTKHQWIGTANYESDYYCFDDINIIRISGNDTVDLTNVIVTGMDNIIVIRKIFGNTTILVPIDVTVTLDVSSIYGSVDFFRCQQYDLRNESIKFKETDNQSL

SEQ ID NO: 640 - protein, 287 aa, Streptococcus pyogenes
DGICHDSLSFDKGLLTFIAFTASFSPFLELGRLPLGFKRAMNAARNIFDLLDENVIVDEGTKQIDRLRSVSFEDLSFAYPKRQELVFKDLTVTFQEKGIIGIKGESGSGKSTLVKLIMKWYNWKTGDIFLNDRNSCLLNAAKLQDTIAYVPQTAQLFQQSIRENLIFGRQDISDESIWNLAEACGMKDRLLACKEGLDTIIKSPSDFSAGEGQRLELMRALLKDASCYIFDEPTSNLDSLNEAILLDLIKTHCQGLVFLISHRPSTLACVDHLFCVKNGSLKEVNKK

SEQ ID NO: 641 - protein, 84 aa, Streptococcus pyogenes
GVLPLIPLSIVAMQKRSQPNMSHYWSSYMDVGNLFMDDLKGLNTLYSYQATERYEQEFSGKAEQFRKATMSLLGFQLQAVGYMD

SEQ ID NO: 642 - protein, 289 aa, Streptococcus pyogenes
TPIREQGYGMHLVMMNTKMADRIFSFLDSVPARKDNKSKTAINFNQIDIQNISLAYEKKTVLSGVTMTLTKGQLTAIAGVSGQGKTSLAQLLLKRQSATTGHILFDGLDSDNLSQETINQQVLYVSDQSTLLNRSIYDNLRLAANLSKKEILDWIDQHGLLSFINWLPDGLDTIVGENGNLLSPGQKQQVICARALLSKRSLYIFDEATSSLDAENERIIDNLITRLAKTAIVIVITHKMSRLKGANQVLFLNTGQPACLGKPCDLYRDQPTYRHLVDTQARLEASIYG

SEQ ID NO: 643 - protein, 197 aa, Streptococcus pyogenes
YAYSLNGIERLTPSAIEYNVESENGQVNVTTILENDQVSLVDVGLLRLNTIPEVTITDSGQTIPYFDIINYSDYKELMKAQGRTNSIEGSKSLPLLINYYPTEISLGKTFNLGNAYDVTVKQVSTNNVFSFSTSVTTLVVSDKLYAKLSSRFPEKEMTIRTFNGTSIRSSEAFYNQFSMVPDVISSYSKEHTVKTAN

SEQ ID NO: 644 - protein, 149 aa, Streptococcus pyogenes
QGGMPDFSSNHVRVQENGAAAKAGLRDNDQIVAINGYKVTSWNDLTEAVDLATRDLGPSQTIKVTYKSHQRLKTVAVKPQKHAKTYTIGVKASLKTGFKDKLLGGLELAWSRAFTILNALKGLITGFSLNKLGGPVAMYDMSNQAAQNG

SEQ ID NO: 645 - protein, 73 aa, Streptococcus pyogenes
KQSPVDPVMASVNYDTSLTPAQYKAIAHHYGLDKPALVQYFIWLKNVIQGDLGTSLVYRQPVSDIIRSRAGAS

SEQ ID NO: 646 - protein, 112 aa, Streptococcus pyogenes
SSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 647 - protein, 112 aa, Streptococcus pyogenes
GWQYALYSMVSIFVSSRVTDAIFTKQKKMQATIVTSHPERVIHMIHKRLHRGVTSINDAEGTYKHEQKAVLITILTCEEYPEFKWLMLKTDPQAFVSVAENVRIIGRFVEDD

SEQ ID NO: 648 - protein, 547 aa, Streptococcus pyogenes
GSMWDPYGRVNDLPIAVVNHDKPAKRADKSLTIGNDMVDKMSKSKDLEYHFVSAKQAQEGLKEGDYYMVITLPEDLSQRAATLLNPEPQKLTIRYQTSKGHGMVAAKMGETAMAKLKESVSQNITKTYTSAVFSSMTDLQSGLKEASAGSQALASGAKTAQAGSQTLSTNLAALTGASQQFQQGTGRLTSGLTTYTDGVNQVKNGLGTLSTDIPNYLNGVSRLSQGASQLNQGLSQLTQATTLSDEKAKGIQSLIVGLPVLNQGIQQLNTELSTLQPPNLNADELGNSLGAIAQAAKQVIAEETAAQNEELSALQATSVYQSLTAEQQGELAAALSQSDKSQTVSAAQTILSSVQTLSTSLQSLSQEDQSKQLEQLKEAVAQIANQSNQALPGASSALTELSTGLAKVNGSLNQQVLPGSNQLTTGLAQLNRYNTAIGSGVIKLSEGANALSSKSGELLDGSHQLSEGATKLADGSSQLSQGGHQLTSGLTELSTGLSTLNGSLAKASQQLSLVSVTDKNAKAVAKPLVLNEKDKDGVKTNGIGMAP

SEQ ID NO: 649 - protein, 379 aa, Streptococcus pyogenes
NTYYQLQGINKEWGFPSRQIYNSQLKDINNLVNSVSKNSQPFFRMERLLPQTGNDSMKFNYYGISQFSSVRNRLSSSLLDRLGFQSKGTNLNLRYQNNTIIMDSLLGIKYNLSEGPPNKFGFTKLKTSGNTTLYQNHYSSPLAILTRNVYKDVNLNVNTLDNQTKLLNQLSGKSLTYFNLQPAQLISGANQFNGQISAQASDYQNSVTLNYQINIPKHSQLYVSIPNIIFSNPDAKEMRIQTDNHNFIYTTDNAYSFFDLGYFADAKVATFSFVFPKNKQISFKEPHFYSLSIESYLEAMNSIKQKNVHTYAKSNTVITDYNSKTKGSLIFTLPYDKGWSAQKDGKNLPVKKAQGGFLSVTIPKGKGRVILTFIPNGFK

SEQ ID NO: 650 - DNA, 1977 bp, Streptococcus pyogenes
atgaaaaataataaaaataatggttttgttaaaaattcttttatatatatattgatgattattgttgtcatcacaggatttcaattttatcttaagggaaccagcacacaaagccaacagattagttattccaaattaattaaacatcttaaggctggagatataaaatctttaagttatcagcctagcggtagtattattgaagttaaagggaaatatgagaaacctcaaaaagtgacagttaattcaggactatcatttttaggtggaagagcttcaacacaggtaacagagttctcatctttagtattacctagtgataccatcttgaaagaaatgacagcagcagctgataaaaatggaacagagcttacagttaagcaggaaagttcaagtggtacttggattaccttcttaatgagctttttacctattgttatttttgctgctttcatgatgatgatgatgaatcaaggtggtggaggagctcgtggtgctatgagtttcggcaaaaataaggcaaaatctcaatcaaaaggtaatgttaaagtgagatttacagacgttgctggtgccgaagaagaaaaacaagaattagtagaagttgttgattttttgaaaaatcctaaaaaatataaatcactaggagcacggattccagcgggagttcttctagaggggcctccaggtactggtaaaacattactagctaaagctgtagcaggtgaagctggagtgccatttttcagtatttcaggttcggattttgtcgaaatgtttgtcggtgtaggtgctagtcgtgttcgttctttatttgaggatgctaaaaaagctgagcgtgcgatcatctttatcgatgaaattgacgctgtaggtcgtcgtcgtggtgctggcatgggaggcggtaacgatgaacgagaacagacccttaaccaattactcattgaaatggatggttttgagggtaatgagaacattatcgttattgctgcaactaaccgtagtgatgttttagatccagctttactaagaccaggtcgttttgatcgtaaggttttagttggtcgccctgatgttaaaggacgtgaagccattttacgtgttcatgctaaaaataaaccacttgcaaatgacgttaatttgaaagtagtagcccaacagactccaggttttgtaggtgctgatcttgaaaatgttttaaatgaagctgcgttggttgctgctcgcagaaataaaattaaaattgatgctagtgatattgatgaagctgaagatcgtgttattgctggaccatcaaagaaagatcgcactatttcgcaaaaagagcgagaaatggttgcttatcacgaagctggtcatactattgttggtttagttttatctaatgcgcgtgtagttcacaaggtaactattgtacctcgtggacgagcaggtggttatatgatcgctcttccaaaagaagatcaaatgcttctttctaaagaagatctgaaagagcaattagcaggattgatgggtggtcgtgttgctgaagaaattgtttttaatgctcaaacatcaggtgcgtcaaatgactttgagcaagctactcagatagcaagggccatggttacggaatatggtatgagtgaaaagcttggaccagttcaatatgaaggtaaccatgcgatgatgccaggacagatctctcctgaaaaagcttactctgcccaaacagctcaaatgattgatgatgaggttcgtgaactcttaaatcaagctcgtaatcaagcagctgatatcatcaatgagaatcgagatactcataaattgattgctgaagctcttctcaaatatgaaactctagacgctgcacaaattaaatcaatttatgaaactggtaaaatgccagttgatttagaaactgatgataatgaagctcatgcgttatcttatgacgaaattaaaaataaaatgacagaatctgaatctgcagaa

SEQ ID NO: 651 - DNA, 1194 bp, Streptococcus pyogenes
atgaaaaaaagaattttatcagcagttcttgtaagtggtgttaccctcggagcagctacaactgtaggagcggaggatttaagtactaagattgctaagcaagattctattatctcaaatctgactacagagcaaaaagctgcacagaatcaagtttcagcgttacaggctcaagtaagttcactacaatctgaacaagataaactgaccgcaagaaatacagaacttgaggcgctttcaaagcgatttgagcaagaaattaaggctctaacaagtcaaattgttgctcgtaatgaaaaattaaaaaatcaagctcgtagtgcttataaaaacaatgaaacttctggttatattaatgcacttttgaattctaaatcaatttctgatgttgtaaaccgtttagtagcaattaatagagctgtctctgctaacgctaaattgttagaacaacaaaaagctgataaagtttcccttgaagaaaagcaagctgctaaccaaacagctattaataccattgccgctaatatggcaatggctgaagaaaaccaaaatacattacgtactcaacaagctaatttggtagctgcaactgcaaatttagctctccaattagcatctgctactgaagataaagctaatttggtagctcaaaaagaagctgcagaaaaagctgctgctgaagccttagcacaagaacaggctgctaaagttaaggcacaagaacaggctgcacaacaagcagcatctgttgaagcagcaaaatctgctattactccagcaccacaagctactccggcagcgcaaagtagtaatgctattgaaccagctgcactcacggctccggcagctccttctgcaggaccacaaacatcatatgattcttctaatacttatccagttggacaatgcacatggggagctaaatctttagctccttgggcaggaaataattggggaaatggtggtcaatgggcttatagtgctcaagcagctggttatcgtactggttcaacgccgatggtaggtgcgattgccgtttggaacgatggtggttatggacatgtcgccgttgtagttgaggttcaaagtgcctcaagtattcgtgtgatggagtctaactacagtggtagacagtacattgctgaccaccgtggctggtttaatccaacaggtgttacatttatttatccacac

SEQ ID NO: 652 - DNA, 1122 bp, Streptococcus pyogenes
atgaaaaaatttcatcgttttttggtctcaggagtaatccttttaggttttaatggtctagtacctactatgccatctacacttatttcgcaacaggaaaatcttgttcatgcagctgttttaggcgataactatccgagtaagtggaaaaaaggcaatggaatcgattcgtggaacatgtatatccgccaatgcacttcttttgcagcttttcgtttaagctctgctaatggttttcagttacctaaaggctacggtaatgcctgcacgtggggacatatcgcgaaaaatcagggttatcctgtgaataagacaccaagcataggggctatcgcttggtttgataaaaacgcttatcagtcaaatgctgcttacggtcatgtagcatgggtagctgatatccgtggagacactgtcactatcgaagagtataattacaacgctggacaaggccctgaaagataccataagcgtcaaattccaaaatctcaggtaagtggttatatccattttaaagacttatcatctcagacaagtcattcctacccaagacaactaaaacacatttctcaagcttcatttgacccctctggaacttatcactttacaaccagattaccagtcaaaggacaaaccagtatcgatagccctgatcttgcttactatgaagcaggtcaatctgtttattacgataaagtcgtgactgctggaggttatacatggcttagctacctcagtttttctggaaaccgacgctatattcccattaaagagcccgcacagtctgtggttcaaaatgacaatacaaaaccttccattaaggtcggtgatactgttaccttccctggcgtttttcgtgtagatcagcttgttaataatttgatcgttaataaagaattagccggaggagacccaactccactaaactggattgatcccacaccattagatgaaacagataaccaaggaaaagttttaggagatcaaattctccgtgtgggtgaatattttatcgtcactggtagttataaagtattaaaaattgatcaaccaagtaatggtatttatgttcaaatcggatctcgtggaacatgggtaaatgctgataaagctaacaaatta

SEQ ID NO: 653 - DNA, 2310 bp, Streptococcus pyogenes
atgaggtattttatggtgaaatggaacacgaaacaaaagcgtataagtcatcaaagattaggtctcttggatttggggccggtgctattacgtacgttgagactactgtctaactttttttatattgttatcttcctttttggaatgatgggatttggtatggcatttgggtatttggctagtcagattgaatctgttaaggtaccaagtaaagaaagtttagtcaaacaagttgaatcattaacgatgatttcgcaaatgaactattctgataatagtttaatttctactttagatacggatttacttcgaacaccagtagctaatgatgcgatttcagagaatatcaaaaaagctattgtatcaacagaagacgaacattttcaagaacataaaggtatcgtgccaaaagctgtttttcgggcaacattggcttctgtattgggatttggagaagctagtggaggttcgaccttaacacagcaattagtcaagcaacaagttttgggagacgatcccacatttaagcgcaagtctaaggagatcgtttacgctcttgccttagagcgttatatgtccaaagacaatatcttatgtgattatcttaatgtttcaccttttggccgtaacaacaagggtcaaaatattgctggtgttgaagaagctgcgcgtggcatttttggcgtttctgccaaagatttaacggtgccacaggcagcatttttggcgggtcttccgcagagtcctattgtttactctccttatttgtcaacgggacaactgaaatcagaaaaggacatggcttatggcatcaagcgtcagcaaaatgttctctttaacatgtaccgtacaggtgttctgtctaaaaaagaatacgaggactataaggcttatccgattcaaaaggattttattcaaccgggaagtgcaatagtaaataatcacgattacctttattacacggtgttagcggatgctaagaaagccatgtatagctatttgattaagcgagataaggtgtctagtcgtgacttgaaaaatgacgagactaaggctgcttatgaagagagagccttaacagaattgcaacagggtggctataccatcaccacaaccattaataagcctatttacaatgcgatgcagacagcggcagctcagtttggtggcttgttagatgatggcactggtacagttcaaatgggaaatgtcttgacagacaatgcgactggtgctgtgttaggttttgttggtggtagagattatgctctgaatcaaaataatcatgctttcaatacagttagatcgccaggttctagcattaaaccgataatcgcttatggtcctgctattgatcaaggtttaatggggagtgctagcgttttgtctaattacccaacaacttactcgagtggccaaaaaatcatgcatgctgatagtgaaggaacagccatgatgccacttcaagaggccctaaatacttcttggaacatcccagctttttggacacagaaattactgcgtgaaaaaggtgtcgatgtcgaaaattatatgacaaaaatgggttataagattgcagactactcgattgaaagtttacctctagggggcggtattgaagtctcggttgctcaacaaaccaatgcttaccaaatgctttcaaacaatggcttatatcaaaagcaatatattgtagataagattactgctagcgatggtacagtcgtttacaaacatgaaaataagccaattcgtattttttctgcagcaacagctacgattttacaagaattgttgagaggtccgattacttcaggcgctacgactactttcaagaaccgtttggcggctattaatccgtggcttgctaatgctgattggattggtaagaccggaacaactgagaattatacggatgtttggctagtcctgtctactccaaaagttactttaggcggttgggcaggacatgatgacaatacctcattagcgccattaacaggatataacaataattctaattatcttgcctatttagctaatgccattaatcaggccgatcccaatgttattggagtagggcaacgcttcaacttagatccaggagtcattaaggcgaatgtcttgaagtcaacaggtttacaaccaggaactgttaatgtcaatggacatactttttctgttggtggagaaatgaccaccagtctatggtcccaaaaaggaccgggggctatgacttaccgatttgctattggtggcacggatgccgattatcaaaaagcctgggggaacttcgggttcagaaaaaat

SEQ ID NO: 654 - DNA, 2274 bp, Streptococcus pyogenes
atgaaaaaaacaaggtttccaaataagcttaatactcttaatactcaaagggtattaagtaaaaactcaaaacgatttactgtcactttagtgggagtctttttaatgatcttcgctttggtaacttccatggttggtgctaagactgtttttggtttagtagaatcctcgacgccaaacgcaataaatccagattcaagttcggaatacagatggtatggatatgaatcttatgtaagagggcatccatattataaacagtttagagtagcacacgatttaagggttaacttagaaggaagtagaagttatcaagtttattgctttaatttaaagaaagcatttcctctcggatcagatagtagtgttaaaaagtggtataaaaaacatgatggaatctctacaaaatttgaagattatgcgatgagccctagaattacgggagatgagctaaatcagaagttacgagctgttatgtataatggacatccacaaaatgccaatggtattatggaaggcttggaacccttgaatgctatcagagttacacaagaggcggtatggtactattctgataatgctcctatttctaatccagatgaaagttttaaaagggagtcagaaagtaacttggttagtacttctcaattatctttgatgcgtcaagctttgaagcaactgattgatccgaatttggcaactaaaatgccaaaacaagttccggatgattttcagctaagtatttttgagtctgaggacaagggagataaatataataaaggataccaaaatcttttgagtggtggtttagttcctactaaaccaccaactccaggagacccaccaatgcctccaaatcaacctcaaacgacttcagtacttattagaaagtatgctataggtgattactctaaattgcttgaaggtgcaacattacagttgacaggggataacgtgaatagttttcaagcgagagtgtttagcagtaatgatattggagaaagaattgaactatcagatggaacttatactttaactgaattgaattctccagctggttatagtatcgcagagccaatcacttttaaggttgaagctggcaaagtgtatactattattgatggaaaacagattgaaaatcccaataaagagatagtagagccttactcagtagaagcatataatgattttgaagaatttagcgttttaactacacaaaactatgcaaaattttattatgcaaaaaataaaaatggaagttcacaggttgtctattgctttaatgcagatctaaaatctccaccagactctgaagatggtgggaaaacaatgactccagactttacaacaggagaagtaaaatacactcatattgcaggtcgtgacctctttaaatatactgtgaaaccaagagataccgatcctgacactttcttaaaacatatcaaaaaagtaattgagaagggttacagggaaaaaggacaagctattgagtatagtggtctaactgagacacaattgcgtgcggctactcagttagcaatatattatttcactgatagtgctgaattagataaggataaactaaaagactatcatggttttggagacatgaatgatagtactttagcagttgctaaaatccttgtagaatacgctcaagatagtaatcctccacagctaactgaccttgatttctttattccgaataacaataaatatcaatctcttattggaactcagtggcatccagaagatttagttgatattattcgtatggaagataaaaaagaagttatacctgtaactcataatttaacattgagaaaaacggtgactggtttagctggtgacagaactaaagatttccattttgaaattgaattaaaaaataataagcaagaattgctttctcaaactgttaaaacagataaaacaaacctcgaatttaaagatggtaaagcaaccattaatttaaaacatggggaaagtttaacacttcaaggtttaccagaaggttattcttaccttgtcaaagaaacagattctgaaggctataaggttaaagttaatagccaagaagtagcaaatgctacagtttcaaaaacaggaataacaagtgatgagacacttgcttttgaaaataataaagagcctgttgttcctacaggagttgatcaaaagatcaatggctatctagctttgatagttatcgctggtatcagtttggggatctggggaattcacacgataaggataagaaaacatgactag

SEQ ID NO: 655 - DNA, 1020 bp, Streptococcus pyogenes
atgaaattacgtcacttactattaacgggagcagccctaactagttttgctgctacaacagttcacggggagactgttgtaaacggagccaaactaacagttacaaaaaaccttgatttagttaatagcaatgcattaattccaaatacagattttacatttaaaatcgaacctgatactactgtcaacgaagacggaaataagtttaaaggtgtagctttgaacacaccgatgactaaagtcacttacaccaattcagataaaggtggatcaaatacgaaaactgcagaatttgatttttcagaagttacttttgaaaaaccaggtgtttattattacaaagtaactgaggagaagatagataaagttcctggtgtttcttatgatacaacatcttacactgttcaagttcatgtcttgtggaatgaagagcaacaaaaaccagtagctacttatattgttggttataaagaaggtagtaaggtgccaattcagttcaaaaatagcttagattctactacattaacggtgaagaaaaaagtttcaggtaccggtggagatcgctctaaagattttaattttggtctgactttaaaagcaaatcagtattataaggcgtcagaaaaagtcatgattgagaagacaactaaaggtggtcaagctcctgttcaaacagaggctagtatagatcaactctatcattttaccttgaaagatggtgaatcaatcaaagtcacaaatcttccagtaggtgtggattatgttgtcactgaagacgattacaaatcagaaaaatatacaaccaacgtggaagttagtcctcaagatggagctgtaaaaaatatcgcaggtaattcaactgaacaagagacatctactgataaagatatgaccattacttttacaaataaaaaagactttgaagtgccaacaggagtagcaatgactgtggcaccatatattgctttaggaattgtagcagttggtggagctctttactttgttaaaaagaaaaatgct

SEQ ID NO: 656 - DNA, 3495 bp, Streptococcus pyogenes
atgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagat

SEQ ID NO: 657 - DNA, 876 bp, Streptococcus pyogenes
atgattagaaagtatgaccgcacgagcacaaaaaagaaatcactaaactggatttggctaatcattgctttttttatgatttcaagctttataggtggctcttcttttactgagtcacttctagacattttgcctgccatagccattggtggtacaggttatgctatttttcgtgttagatctcatcaaaagcggctagcaaaggccaagattgccaaacaattagaagatctaaaagcaaaaattcagctagctgatcgtaaagttcggctgttagacacttatctggcagaccatgatgacttccaatataacgtactagctcagcaattattaccacaacttagtgacatcaaagcaaaagctattacgttaaaagaccagttagatccccaaatttatcgtcgtatcaccaaaaaagccaatgacgttgaaagtgatattacccttcaactcgaaacactgcagattgccacaactcttaaccctcagcctttgaaaaccccatctcctaatcttattaacaaagcacctgagctcaaaccgtattatgataatattcagacagatcatcaagctatccttgctaaaatccaaggagccgacaatcaagaagaattgcttgcgctgcatgatgctaacatgaggaggtttgaggatatcttaacaggctacttaaaaatcaaagaagagcctaaaaattactataacgctgctgctcgtttagaacaagccaaacaagctatccaacaatttgatgaagatcttgacgaaacccttcgtcgactcaatgaaagtgatcttaaagattttgatattagccttcgaatcatgcaaggtgctactcaaagacgaacaacgcatcaccaaaaagac

SEQ ID NO: 658 - DNA, 1026 bp, Streptococcus pyogenes
atgtcacttggtcttgtttcgactgccctattcacattaggaggctgtaccaataactccgctaaacaaacaactgacaattcattaaaaatcgctatgattactaatcagacgggtattgatgacaagtcatttaaccagtcagcctgggaaggcttacaagcttggggaaaagaaaataaacttgaaaaaggaaaaggctatgattatttccaatcagccaatgaatcagagtttaccacaaaccttgagtcagcagtaaccaatggttataatcttgtttttgggattggatttccattacatgacgctgtagaaaaagtagccgcaaacaatcctgacaaccattttgcaattgtggatgatgtgattaaaggtcaaaaaaatgttgcaagtatcaccttttcagaccatgaagcggcatacctagccggtgttgcagcagctaaaacgacaaaaaccaagcaagttggttttgtaggtggtatggaaggagatgttgtcaagcgctttgaaaaaggttttgaagctggtgtgaaatcagtagatgataccatcaaagtaagagttgcttatgcaggctcttttgcagatgctgccaaaggcaagacgattgcagctgctcaatacgctgaaggcgcagatgttatttatcatgcagcaggaggcacaggggcgggtgtctttagcgaagctaagtctatcaacgaaaaacgtaaagaagaagataaggtttgggttattggtgttgaccgtgaccaaagtgaagatggaaaatacactacaaaagatggcaagtcagctaattttgttttgacctcaagtatcaaggaagtcggaaaagctttagtaaaagtagccgtaaaaacctcagaagaccaattcccaggtggtcaaataaccacttttggtttaaaagaaggtggtgttagccttacaacggatgctctgacacaagacactaaaaaagctattgaggctgctaaaaaagcgattatcgaaggaaccatcacagttcctgaaaac

SEQ ID NO: 659 - DNA, 1341 bp, Streptococcus pyogenes
atgagaaacaaaaaagtaacattagctcatattgtcgcaaagacaagtgttgctattgctttggctggagcaatgggtagcagtttattagctaatagcacaacgtacgctgttagtggcaaagaaaataaaaaaagcgatgtcaaatatgaaacgaccaaagttatggaagctaacgcaacttcctctaaagaagacaatcatgtcatgcacacattagacggctcaatgagtactgtctgggaggaaaattcacctggtggtggtgttggtgaagtactttcctacaagtttgcgtccccgatgcatattgggagaattttaattgttaatggagatacatctagcaaggagaattactacaagaaaaatagaattgcaaaggctgatgttaaatactataacaggaataaattggtcctctttcaaaaaattgaattaggcgacacctacactaaaaaaccgcatcacattgagattgataaaaaattagatgttgatcgtattgatattgaggtaacagaggtccatcagggacaaaacaaggatattttagccttgtcagaggtcacttttggcaatatagaacgcgatatttttgaaaaaaagtttaaagaaattaaagataaatgggtaacagataaacaagcagatgagtttattgaaactgccgacaagtatgctgataaagctgttcagatgtctgctgttgcgtcacgtgctgagtattatcggatgtacgttagccgcaaataccactacaaaaaagagtttgttgaaaaactaaaacaagtctacaaagaaagcggagcttcccacgttacaagcaaaaaagatgtgatgttagcttttgacgatgctaaaaaaaagtcaacgattggtcgacaagaaaacggtctttttgtgacaagttttgctgaggatatggctttgctctttactgatcaaggtaagttaaaatcagctgaccaaattgaaaatataaaagatgtcgatagcggaaaatatagcgatggggtttatcaatatgagtacgattctgaactaacaaaaaacattgataagctaggctatatccgaacagctagcggagatactcctggagcaaattcgctcaacgttcctggttgccaaacgtggtcaggaaaacacattgaaaattcagaaagtgaattaattttcccatcgattagtgttaaagatctaaaatctaaagctgtcttagcagagattgatgccaaaggctattttgaaattattgatcctaccatcattgctccaaatggtgaccataaaaaagtaactggtcgcttcaaaattaagaaaatgcaagataggaag

SEQ ID NO: 660 - DNA, 1713 bp, Streptococcus pyogenes
atgtctaataaaaaaacatttaaaaaatacagtcgcgtcgctgggctactgacggcagctcttatcattggtaaccttgttactgctaatgctgaatcgaacaaacaaaacactgctagtacagaaaccacaacgacaaatgagcaaccaaagccagaaagtagtgagctaactactgaaaaagcaggtcagaaaacggatgatatgcttaactctaacgatatgattaagcttgctcccaaagaaatgccactagaatctgcagaaaaagaagaaaaaaagtcagaagacaaaaaaaagagcgaagaagatcacactgaagaaatcaatgacaagatttattcactaaattataatgagcttgaagtacttgctaaaaatggtgaaaccattgaaaattttgttcctaaagaaggcgttaagaaagctgataaatttattgtcattgaaagaaagaaaaaaaatatcaacactacaccagtcgatatttccattattgactctgtcactgataggacctatccagcagcccttcagctggctaataaaggttttaccgaaaacaaaccagacgcggtagtcaccaagcgaaacccacaaaaaatccatattgatttaccaggtatgggagacaaagcaacggttgaggtcaatgaccctacctatgccaatgtttcaacagctattgataatcttgttaaccaatggcatgataattattctggtggtaatacgcttcctgccagaacacaatatactgaatcaatggtatattctaagtcacagattgaagcagctctaaatgttaatagcaaaatcttagatggtactttaggcattgatttcaagtcgatttcaaaaggtgaaaagaaggtgatgattgcagcatacaagcaaattttttacaccgtatcagcaaaccttcctaataatcctgcggatgtgtttgataaatcggtgacctttaaagagttgcaacgaaaaggtgtcagcaatgaagctccgccactctttgtgagtaacgtagcctatggtcgaactgtttttgtcaaactagaaacaagttctaaaagtaatgatgttgaagcggcctttagtgcagctctaaaaggaacagatgttaaaactaatggaaaatattctgatatcttagaaaatagctcatttacagctgtcgttttaggaggagatgctgcagagcacaataaggtagtcacaaaagactttgatgttattagaaacgttatcaaagacaatgctaccttcagtagaaaaaacccagcttatcctatttcatacaccagtgttttccttaaaaataataaaattgcgggtgtcaataacagaactgaatacgttgaaacaacatctaccgagtacactagtggaaaaattaacctgtctcatcaaggcgcgtatgttgctcaatatgaaatcctttgggatgaaatcaattatgatgacaaaggaaaagaagtgattacaaaacgacgttgggacaacaactggtatagtaagacatcaccatttagcacagttatcccactaggagctaattcacgaaatatccgtatcatggctagagagtgcactggcttagcttgggaatggtggcgaaaagtgatcgacgaaagagatgtgaaactgtctaaagaaatcaatgtcaatatctcaggatcaaccttgagcccatatggttcgattacttataag

SEQ ID NO: 661 - DNA, 702 bp, Streptococcus pyogenes
atgaaaaaaacaaaacttattttttcttttacttcaatattcattgcaataatttctcgtcctgtgtttggattagaagtagataataattcccttctaaggaatatctatagtacgattgtatatgaatattcagatacagtaattgattttaaaaccagtcataacttagtgactaagaaacttgatgttagagatgctagagatttttttattaactccgaaatggatgaatatgcagccaatgattttaaagatggagataaaatagctatgttctccgtcccatttgattggaactacttgtcagaaggaaaagtcatagcatatacctatggtggaatgacgccttatcaagaagaaccaatgtctaaaaatatccctgttaatttatggattaatagaaagcagattcctgtcccctataatcaaatatcaactaacaaaacaacagttacagctcaagaaattgatctaaaggttagaaaatttttaatatcacaacatcaattatattcttctggttctagctacaaaagtggtaaattagtttttcatacaaatgataattcagataaatattctctcgatcttttctatgtaggatatagagataaagaaagtatttttaaagtatacaaagacaataaatctttcaatatagataaaattgggcatttagatatagaaattgactcctaa

SEQ ID NO: 662 - DNA, 702 bp, Streptococcus pyogenes
atgaaaacaaacattttgacaattatcatattatcatgtgtttttagctatggaagtcaattagcttatgcagatgaaaatttaaaagatttaaaaagaagtttaagatttgcctataatattaccccatgcgattatgaaaatgtagaaattgcatttgttactacaaatagcatacatattaatactaaacaaaaaagatcggaatgtattctttatgttgattctattgtatctttaggcattactgatcagtttataaaaggggataaggtcgatgtttttggtctcccttataatttttccccaccttatgtagataatatttatggtggtattgtaaaacattcgaatcaaggaaataaatcattacagtttgtaggaattttaaatcaagatgggaaagaaacttatttgccctctgaggctgttcgcataaaaaagaaacagtttactttacaggaatttgattttaaaataagaaaatttctaatggaaaaatacaatatctatgattcggaatcgcgttatacatcggggagccttttccttgctactaaagatagtaaacattatgaagttgatttatttaataaggatgataagcttttaagtcgagacagtttctttaaaaggtataaagataataagatttttaatagtgaagaaattagtcattttgatatctacttaaaaacgcac

SEQ ID NO: 663 - DNA, 825 bp, Streptococcus pyogenes
ttgagaaaggttttgagagtgaagaaaaacattaaaattgcaagaatagtccccttagttctattattagtggcctgtggtcgtggtgaggtaacggcacaatcatctagtggttgggaccagttggtttacttatttgccagagcaattcaatggctttcctttgatggttcaattggtgttggcattattctttttacccttactatccgtctcatgctcatgcctttgtttaacatgcaaatcaaatcaagccagaagatgcaagacatccaacctgagcttagagaattgcaaaggaaatacgctggtaaagacacacaaacgcggatgaagttggctgaagaaagtcaagccctttacaaaaaatatggggttaacccttatgctagtctcttacccctcttaattcagatgccagttatgattgccttattccaagccttgacacgggtatctttcttaaaaacagggactttcttgtgggtggaattggcacaacatgatcatttgtaccttttaccagttttggcagctgtcttcactttcttgtccacttggttgaccaatctagcggctaaagaaaaaaatgtcatgatgactgttatgatttatgtgatgccgctaatgatctttttcatgggctttaacttggctagtggagtagtgctctattggacggtctccaatgcctttcaagtggtacaactactgttattaaacaatccttttaagattattgcggaaagacaacgtcttgccaatgaagaaaaagaacgccgtcttcgtgaacgtcgtgctcgtaaaaaagcaatgaagagaaaa

SEQ ID NO: 664 - DNA, 1317 bp, Streptococcus pyogenes
atgaacatgaagaagttagcttcattagcgatgcttggtgcatctgttttaggactagcagcttgtggcggaaagagccagaaagaggctggtgcaagtaaatctgatactgctaagacagaaatcacatggtgggctttcccggtcttcacgcaagaaaaagctgaagatggtgtgggaacctatgagaagaaattgattgctgcctttgagaaagctaatccagaaatcaaggtaaaattggaaaccattgattttacatctggtcctgagaaaatcacaactgctattgaagctggaacagctcctgatgtcctctttgatgctccaggtcgtatcattcaatatggtaaaaatgggaaattggctgacttgaatgacttgttcacagaagagtttaccaaagatgttaacaatgacaaattgattcaagcctcaaaagcaggagatacagcttacatgtatcctatcagctctgctccattctacatggcgttgaataaaaaaatgctcaaagatgctggcgtccttgatcttgtgaaagagggttggacaacagatgattttgaaaaagtcttgaaagcattgaaggacaaaggatataacccaggttctttctttgctaatggtcaaggtggtgaccaaggaccacgtgccttctttgctaacctttatagtagtcatattaccgatgacaaagtaaccaaatacaccacagatgatgctaactctattaaagccatgaccaagatttccaattggattaaagatggtttaatgatgaatggctctcagtacgatggttcagctgatattcaaaactttgcgaatggccaaacttcctttaccattctttgggcgcctgcacaaccaggcatccaagctaaattgttagaagctagtaaagtggattaccttgaaatcccattcccatcagatgatggcaaaccagaactagaatacctcgtaaatggttttgcggtctttaataacaaagatgaacaaaaagtcgctgcctctaagacatttatccaatttatcgctgatgataaagaatggggacctaaaaatgttgttcgtacaggtgctttccctgtaagaacttcttatggggatctttacaaagacaaacgaatggaaaaaattgctgaatggacaaaattctactcaccatactataacacgattgatgggtttgctgaaatgagaactctttggttcccaatggttcaagccgtctctaatggtgatgaaaagccagaagatgctttgaaagccttcactgaaaaagcaaacaagacaatcaaaaaaacacaa

SEQ ID NO: 665 - DNA, 1272 bp, Streptococcus pyogenes
atggaccttatcttgttccttttggtcttggttctcttaggtttaggggcttatctgttgttcaaagtcaacggccttcaacatcagcttgcccaaaccctagaaggcaacgcggataatttgtctgaccaaatgacctaccagttggatacagctaacaaacaacaattgttagagctaacacagctgatgaaccgacaacaagcaggcctttaccaacaattaacagatattcgtgacgtcttgcaccgtagtttgtctgatagtagggaccggtctgacaaacgcttagaaaaaattaaccagcaggtcaaccaatcgctcaaaaatatgcaagaatctaacgaaaaacgtttggagaaaatgcgccagatcgttgaagaaaaattggaagaaaccttaaaaaatcgtctgcacgcctctttcgattctgtatccaagcaactagaaagtgtcaataaaggcttgggagaaatgcgtagcgtggctcaagatgtgggtactttaaataaggttttgtccaataccaaaacacgaggcattttaggcgaacttcaactaggccaaatcattgaggatatcatgacatcaagccagtacgaaagagaatttgtaacggttagtggttctagtgaacgcgtagaatatgcgattaagctcccaggaaatggtcaaggcggttatatttacctaccgattgactcaaaattccctcttgaagattattaccgattagaagatgcttacgaagttggtgataaactggccatcgaggctagccgaaaagcacttctggcagctatcaaacgctttgccaaagacattcataaaaagtacttgaaccccccagagacgaccaatttcggagttatgttcttaccaacagaaggtctttattcagaagtggtcagaaatgcgtctttctttgatagccttcgtcgggaagaaaatattgtggttgcaggcccttcgaccctgtctgctttgctgaattccttatctgttggtttcaagacccttaatatccaaaaaaatgctgatgacatcagtaaaattttaggcaatgtcaagttagaattcgataaatttggcggcctgcttgccaaggctcaaaaacaaatgaatacagctaataatacgctggatcagctcatttcaacaaggacaaatgccattgttcgagccttgaataccgttgaaacttatcaagaccaagcaacaaaatctctcttgaacatgcccttattagaagaggaaaataatgaaaattaa

SEQ ID NO: 666 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 667 - DNA, 2622 bp, Streptococcus pyogenes; identical to SEQ ID NO: 666

SEQ ID NO: 668 - DNA, 2622 bp, Streptococcus pyogenes; identical to SEQ ID NO: 666

SEQ ID NO: 669 - DNA, 2622 bp, Streptococcus pyogenes; identical to SEQ ID NO: 666

SEQ ID NO: 670 - DNA, 2622 bp, Streptococcus pyogenes; identical to SEQ ID NO: 666

SEQ ID NO: 671 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttatactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgacggaagagttggcagctcagaaagctgctctagcagaaaaagaggcagaacttagtcgtcttaaatcctcagctccgtctactcaagatagcattgtgggtaataatactatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtataaaacgtggtatttatgacagtatcaagtatatgctctttacagatcatttacacggaaatacatatggccatgctattaactttttacgtgttgataaacataaccctaatgcacctgtttaccttggattttcaaccagcaatgtaggatctttgaatgaacactttgtaatgtttccagagtctaacattgctaaccatcaacgctttaataagactcctataaaagccgttggaagtacaaaagattatgcccaaagagtaggcactgtatctgatactattgcagcgattaaaggaaaagtaagctcattagaaaatcgtttgtcggctattcatcaagaagctgatattatggcagcccaagctaaagtaagtcaacttcaaggtaaattagcaagcacacttaagcagtcagacagtttaaaccttcaagtgagacaattaaatgatactaaaggttctttgagaacagaattactagtagctaaagcaaaacaagcacaactcgaagctactcgtgatcaatcattagctaagctagcatcgttgaaagccgcaatgcaccagacaaaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 672 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtaa

SEQ ID NO: 673 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 674 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaagactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 675 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacaaagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaagactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatttaagggactttaaattgaatcctaaccgccttcaagtgatacgtgagcgcattgataatattaagcaagatttggctaaaactacctcatctttgttaaatgcacaagaaactttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaggtga

SEQ ID NO: 676 - DNA, 2622 bp, Streptococcus pyogenes
atggacttagaacaaccaaagccaaatcaagttaagcaaaaaattgccttgacatcgactatcgctttattaagtgccagtgtcggtgtgtcccatcatgttaaggcagacgatttggcaccagagggagctaaagcaagtaatactagtgaagagagtcttccaaaaacagaaacttgtgaagaggcgaaggcagctgttgaagctgttgaaactaatctaaatcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaatatcaaagagagttaacagctactgaaacagagcttcataatgctcaagtagatcaacattcaaaagagactgcattgtcagaacaaaaagctagcatttcagcagaaactactcgagctcaagatttagttgaacaagtcaaaacgtctgaacaaaatattgctaagctcaatgctatgattagcaatcctgatgctatcactaaagcagctcaaacggctaatgataatacaaaagcattaagctcagaattggagaaagctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtactaataccatgaaagcaccgcaaggctatcctcttgaggaacttaaaaaattagaagctagtggttatattggatcagctagttacaataattattacaaagagcatgcagatcaaattattgccaaagctagtccaggtaatcaattaaatcaataccaagatattccagcagaccgcactcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggcatcagggcattacggtgttgggcctcatgataaaactattattgaagactctgccggagcgtcaggactcattcgaaatgatgataacatgtacgagaatatcggtgcttttaacgatgtgcatactgtgaatggtataaaacgtggtatttatgacagtatcaagtatatgctctttacagatcatttacacggaaatacatatggccatgctattaactttttacgtgttgataaacataaccctaatgcacctgtttaccttggattttcaaccagcaatgtaggatctttgaatgaacactttgtaatgtttccagagtctaacattgctaaccatcaacgctttaataagactcctataaaagccgttggaagtacaaaagattatgcccaaagagtaggcactgtatctgatactattgcagcgattaaaggaaaagtaagctcattagaaaatcgtttgtcggctattcatcaagaagctgatattatggcagcccaagctaaagtaagtcaacttcaaggtaaattagcaagcacacttaagcagtcagacagtttaaaccttcaagtgagacaattaaatgatactaaaggttctttgagaacagaattactagtagctaaagcaaaacaagcacaactcgaagctactcgtgatcaatcattagctaagctagcatcgttgaaagccgcaatgcaccagacaaaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaaactttagcagccttacaagctaagaaaagcagtctagaagctactattgctaccacagaacaccagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatattgatgaaagtactcaaagagctcttaaagcaggtgtggtcatgctggcggcagttggtttgactggggttaaacttcgtaaggacactaagtga

SEQ ID NO: 677 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttatactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgacggaagagttggcagctcagaaagctgctctagcagaaaaagaggcagaacttagtcgtcttaaatcctcagctccgtctactcaagatagcattgtgggtaataatactatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtataaaacgtggtatttatgacagtatcaagtatatgctctttacagatcatttacacggaaatacatatggccatgctattaactttttacgtgttgataaacataaccctaatgcacctgtttaccttggattttcaaccagcaatgtaggatctttgaatgaacactttgtaatgtttccagagtctaacattgctaaccatcaacgctttaataagactcctataaaagccgttggaagtacaaaagattatgcccaaagagtaggcactgtatctgatactattgcagcgattaaaggaaaagtaagctcattagaaaatcgtttgtcggctattcatcaagaagctgatattatggcagcccaagctaaagtaagtcaacttcaaggtaaattagcaagcacacttaagcagtcagacagtttaaaccttcaagtgagacagttaaatgatactaaaggttctttgagaacagaattactagtagctaaagcaaaacaagcacaactcgaagctactcgtgatcaatcattagctaagctagcatcgttgaaagccgcaatgcaccagacaaaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 678 - DNA, 2622 bp, Streptococcus pyogenes; identical to SEQ ID NO: 671

SEQ ID NO: 679 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacaaagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccatttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 680 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatacttaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacatctattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 681 - DNA, 2561 bp, Streptococcus pyogenes
atggacttagaacaaacgaagccaaaccaagttaagcagaaaattgctttaacctcaacaattgctttattgagtgccagtgtaggcgtatctcatcaagtcaaagcagatgatagagcctcagaagaaacgaaggcgagtaatactcacgacgatagtttaccaaaaccagaaacaattcaagaagcaaaggcaactattgaagcagttgaaaaaactctcagtcaacaaaaaacaaaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccatttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcagg

SEQ ID NO: 682 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaatcttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 683 - DNA, 2622 bp, Streptococcus pyogenes; identical to SEQ ID NO: 673

SEQ ID NO: 684 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgaagcagttgaaaaaactctcagtcaacaaaaagcaaaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgacattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccatttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 685 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaacaacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaaactttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 686 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgaagcagttgaaaaaactctcagtcaacaaaaagcaaaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacaccaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggcaataataccatgaaagcaccacaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacttatggtcatgctattaactttttacgtgtagataaacataaccctaaggcgcctgtttaccttggattttcaaccagcaatgtaggatctttgaatgaacactttgtaatgtttccagagtctaacattgctaaccatcaacgctttaataagacccctataaaaaccgttggaagtacaaaagattatgcccaaagagtaggcactgtatctgatactattgcagcgatcaaaggaaaagtaagctcattagaaaatcgtttgtcggctattcatcaagaagctgacattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaaactttagcagccttacaagctaaacaaagcagtctagaagctactattgctaccacagaacaccagttgactttgcttaaaaccttagctaatgaaaaggaatatcgccacttagacgaagatatagccactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctataggcctcacaggatttaggttccgtaaggaatctaagtga

SEQ ID NO: 687 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgaagcagttgaaaaaactctcagtcaacaaaaaacaaaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattaacaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacttatggtcatgctattaactttttacgtgtagataaacataaccctaaggcgcctgtttaccttggattttcaaccagcaatgtaggatctttgaatgaacactttgtaatgtttccagagtctaacattgctaaccatcaacgctttaataagacccctataaaaaccgttggaagtacaaaagattatgcccaaagagtaggcactgtatctgatactattgcagcgatcaaaggaaaagtaagctcattagaaaatcgtttgtcggctattcatcaagaagctgacattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaaactttagcagccttacaagctaaacaaagcagtctagaagctactattgctaccacagaacaccagttgactttgcttaaaaccttagctaatgaaaaggaatatcgccacttagacgaagatatagccactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 688 - DNA, 2622 bp, Streptococcus pyogenes
atggacttagaacaaacgaagccaaaccaagttaagcagaaaattgctttaacctcaacaattgctttattgagtgccagtgtaggcgtatctcatcaagtcaaagcagatgatagagcctcagaagaaacgaaggcgagtaatactcacgacgatagtttaccaaaaccagaaacaattcaagaagcaaaggcaactattgaagcagttgaaaaaactctcagtcaacaaaaaacaaaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccatttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 689 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaagactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 690 - DNA, 2622 bp, Streptococcus pyogenes
atggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacaaagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaatgaaaatgaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatgactcaggatcttctacaacgagcaatctcatttctgatgttgatgaaagtactcaaagagctcttaaagcaggagtcgttatgttggcagctgtcggcctcacaggatttaggttccgtaaggaatctaagtga

SEQ ID NO: 691 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagtaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgacattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagtcttagcagagcaagccgcagccagagtgacagcactggtggctaaaaaagctcatttgcaatatctaagggactttaaattgaatcctaaccgccttcaagtgatacgtgagcgcattgataatactaagcaagatttagctaaaactacctcatctttgttaaatgcacaagaaactttagcagccttacaagctaaacaaagcagtctagaagctactattgctaccacagaacaccagttgactttgcttaaaaccttagctaatgaaaagggatatcgccatttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 692 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgaagcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagtaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagtattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaagcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatacttaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtgaaactgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 693 - DNA, 2622 bp, Streptococcus pyogenes; identical to SEQ ID NO: 666

SEQ ID NO: 694 - DNA, 2622 bp, Streptococcus pyogenes; identical to SEQ ID NO: 686

SEQ ID NO: 695 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaacaacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatacttaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 696 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgaagcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagtaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaagcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattggctaagctagcatcgttgaaagccgcactgcaccagacagaagccttagcagagcaagccgcagccagagtgacagcactggtggctaaaaaagctcatttgcaatacttaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaagtga

SEQ ID NO: 697 - DNA, 2640 bp, Streptococcus pyogenes
atggaaaaaggagagagaatggacttagaacaaacgaagccaaaccaagttaagcagaaaattgctttaacctcaacaattgctttattgagtgccagtgtaggtgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggccatgctattaactttttacgtgtagataaacgtaaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttgaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacatcagttgactttgcttaaaaccttagctaatgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgttatgttggcagctgtcggcctcacaggatttaggttccgtaaggaatctaggtga

SEQ ID NO: 698 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagtagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgacggaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatatggtcatgctattaactttttacgtgtagataaacataaccctaaggcgcctgtttaccttggattttcaaccagcaatgtaggatctttgaatgaacattttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaacctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaggtga

SEQ ID NO: 699 - DNA, 2622 bp, Streptococcus pyogenes
atggacttagaacaaacgaagccaaaccaagttaagcagaaaattgctttaacctcaacaattgctttattgagtgccagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttatactaatactcttgcaagtagtgaggagacgctattagcccaaggagccgaacatcaaagagagttaacagctactgaaacagagcttcataatgctcaagtagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgacggaagagttggcagctcagaaagctgctctagcagaaaaagaggcagaacttagtcgtcttaaatcctcagctccgtctactcaagatagcattgtgggtaataatactatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaaggagacaattaggtctaccaccagttactgtcacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtataaaacgtggtatttatgacagtatcaagtatatgctctttacagatcatttacacggaaatacatatggccatgctattaactttttacgtgttgataaacataaccctaatgcacctgtttaccttggattttcaaccagcaatgtaggatctttgaatgaacactttgtaatgtttccagagtctaacattgctaaccatcaacgctttaataagactcctataaaagccgttggaagtacaaaagattatgcccaaagagtaggcactgtatctgatactattgcagcgattaaaggaaaagtaagctcattagaaaatcgtttgtcggctattcatcaagaagctgatattatggcagcccaagctaaagtaagtcaacttcaaggtaaattagcaagcacacttaagcagtcagacagtttaaaccttcaagtgagacaattaaatgatactaaaggttctttgagaacagaattactagtagctaaagcaaaacaagcacaactcgaagctactcgtgatcaatcattagctaagctagcatcgttgaaagccgcaatgcaccagacaaaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaatgaaaaggaatatcgccacttagacgaagatatagctactgtgcctgatttgcaagtagctccatctcttacgggcgtaaaaccgctatcatatagtaaggtagagactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaaagagctcttaaagcaggagtcgtcatgttggcagctgtcggcctcacaggatttaggttccgtaaggaatctaggtga

SEQ ID NO: 700 - DNA, 2622 bp, Streptococcus pyogenes; identical to SEQ ID NO: 699

SEQ ID NO: 701 - DNA, 1008 bp, Streptococcus pyogenes
atggtagttaaagttggtattaacggtttcggtcgtatcggacgtcttgcattccgccgtattcaaaacatcgaaggtgttgaagtaactcgtatcaatgaccttacagatccaaatatgcttgcacacttgttgaaatacgatacaactcaaggtcgttttgatggaacagttgaagttaaagaaggtggatttgaagtaaacggaaacttcatcaaagtttctgctgaacgtgatccagaaaacatcgactgggcaactgatggggttgaaatcgttcttgaagcaactggtttctttgctaaaaaagaagcagctgaaaaacacttacatgctaacggtgctaaaaaagttgttatcacagctcctggtggaaacgatgttaaaacagttgttttcaacactaaccacgacattcttgacggtactgaaacagttatctcaggtgcttcatgtactacaaactgtttagctcctatggctaaagctcttcacgatgcattcggtattcaaaaaggtcttatgactacaatccacgcttacactggtgaccaaatgatccttgacggaccacaccgtggtggtgaccttcgtcgtgcacgcgctggtgctgcaaatatcgttcctaactcaactggtgctgctaaagctatcggtcttgttatcccagaacttaacggtaaacttgacggtgctgcacaacgtgttcctgttccaactggatcagtaactgagttggttgtaactcttgacaaaaacgtttctgttgacgaaatcaacgctgctatgaaagctgcttcaaacgatagcttcggttacactgaagatccaatcgtttcttcagatatcgtaggcgtatcatacggttcattgtttgacgcaactcaaactaaagtaatggaagttgacggatcacaattggttaaagttgtatcatggtatgacaacgaaatgtcttacactgctcaacttgtacgtactcttgagtacttcgcaaaaattgctaaa

SEQ ID NO: 702 - DNA, 1263 bp, Streptococcus pyogenes
atgacaaaagaaaaactagtggctttttcgcaagcccacgctgagcctgcttggctgcaagaacggcgtttagcggcattagaagccattccaaatttggaattaccaaccatcgaaagggttaaatttcaccgttggaatctaggagatggtaccttaacagaaaatgaaagtctagctagtgttccagattttatagctattggagataacccaaagcttgttcaggtaggcacgcaaacagtcttagaacagttaccaatggcgttaattgacaagggagttgttttcagtgatttttatacggcgcttgaggaaatcccagaagtaattgaagctcattttggtcaggcattagcttttgatgaagacaaactagctgcctaccacactgcttattttaatagcgcagccgtgctctacgttcctgatcacttggaaatcacaactcctattgaagctattttcttacaagatagtgacagtgacgttccttttaacaagcatgttctagtgattgcaggaaaagaaagtaagttcacctatttagagcgttttgaatctattggcaatgccactcaaaagatcagcgctaatatcagtgtagaagtgattgctcaagcaggcagccagattaaattctcggctatcgaccgcttaggtccttcagtgacaacctatattagccgtcgaggacgtttagagaaggatgccaacattgattgggccttagctgtgatgaatgaaggcaatgtcattgctgattttgacagtgatttgattggtcagggctcacaagctgatttgaaagttgttgcagcctcaagtggtcgtcaggtacaaggtattgacacgcgcgtgaccaactatggtcaacgtacggtcggtcatattttacagcatggtgtgattttggaacgtggcaccttaacgtttaacgggattggtcatattctaaaagacgctaagggagctgatgctcaacaagaaagccgtgttttgatgctttctgaccaagcaagagccgatgccaatccaatcctcttaattgatgaaaatgaagtaacagcaggtcatgcagcttctatcggtcaggttgaccctgaagatatgtattacttgatgagtcgaggactggatcaagaaacagcagaacgattggttattagaggattcctaggagcggttatcgctgaaattcctattccatcagtccgccaagagattattaaggttttagatgagaaattgcttaatcgttaa

SEQ ID NO: 703 - DNA, 1971 bp, Streptococcus pyogenes
atgaagaaaagtaaatggttggcagctgtaagtgttgcgatcttgtcagtatccgctttggcagcttgtggtaataaaaatgcttcaggtggctcagaagctacaaaaacctacaagtacgtttttgttaacgatccaaaatcattggattatattttgactaatggcggtggaacgactgatgtgataacacaaatggttgatggtcttttggaaaacgatgagtatggtaatttagtaccatcacttgctaaagattggaaggtttcaaaagacggtctgacttatacttatactcttcgcgatggtgtctcttggtatacggctgatggtgaagaatatgccccagtaacagcagaagattttgtgactggtttgaagcacgcggttgacgataaatcagatgctctttacgttgttgaagattcaataaaaaacttaaaggcttaccaaaatggtgaagtagattttaaagaagttggtgtcaaagcccttgacgataaaactgttcagtatactttgaacaagcctgaaagctactggaattcaaaaacaacttatagtgtgcttttcccagttaatgcgaaatttttgaagtcaaaaggtaaagattttggtacaaccgatccatcatcaatccttgttaatggtgcttacttcttgagcgccttcacctcaaaatcatctatggaattccataaaaatgaaaactactgggatgctaagaatgttgggatagaatctgttaaattgacttactcagatggttcagacccaggttcgttctacaagaactttgacaagggtgagttcagcgttgcacgactttacccaaatgaccctacctacaaatcagctaagaaaaactatgctgataacattacttacggaatgttgactggagatatccgtcatttaacatggaatttgaaccgtacttctttcaaaaacactaagaaagaccctgcacaacaagatgccggtaagaaagctcttaacaacaaggattttcgtcaagctattcagtttgcttttgaccgagcgtcattccaagcacaaactgcaggtcaagatgccaaaacaaaagccttacgtaacatgcttgtcccaccaacatttgtgaccattggagaaagtgattttggttcagaagttgaaaaggaaatggcaaaacttggtgatgaatggaaagacgttaacttagctgatgctcaagatggtttctataatcctgaaaaagcaaaagctgagtttgcaaaagccaaagaagctttaacagctgaaggtgtaaccttcccagttcaattagattaccctgttgaccaagcaaacgcagcaactgttcaggaagcccagtctttcaaacaatctgttgaagcatctcttggtaaagagaatgtcattgtcaatgttcttgaaacagaaacatcaactcacgaagcccaaggcttctatgctgagaccccagaacaacaagactacgatatcatttcatcatggtggggaccagactatcaagatccacggacctaccttgacatcatgagtccagtaggtggtggatctgttatccaaaaacttggaatcaaagcaggtcaaaataaggatgttgtggcagctgcaggccttgatacctaccaaactcttcttgatgaagcagcagcaattacagacgacaacgatgcgcgctataaagcttacgcaaaagcacaagcctaccttacagataatgccgtagatattccagttgtggcattgggtggcactccacgagttactaaagccgttccatttagcgggggcttctcttgggcagggtctaaaggtcctctagcatataaaggaatgaaacttcaagacaaacctgtcacagtaaaacaatacgaaaaagcaaaagaaaaatggatgaaagcaaaggctaagtcaaatgcaaaatatgctgagaagttagctgatcacgttgaaaaataa

SEQ ID NO: 704 - DNA, 840 bp, Streptococcus pyogenes
atgattaaaaaacagtatttaggaagggcaacaattgccctagcatcgacccttgtgctagcagcttgtgggtcatcaaaaacagctgagtcaggaaatcaggggagttctaaagaagtcttatttgcaacggttggaacaacagctcccttttcttatgaaaaaggtggtcaactaactggctacgatatcgaggtggctaaagcagtctttaaaggatcggatgattacaaggtgtcctttaaaaaaacagaatggtcttctatctttacaggtttggactcaggaaaataccaaatgggtggtaacaacatttcctttaccaaagagcgttcagctaagtaccttttttcttatccaatcggatcaacaccttctgttttagttgttccaaaagacagtgatatcaagagctttgatgatatccaagggcatacgacacaagttgttcaagggactacaagtgttgcacagttagaagactttaataagaaacacagtgacaacccggttactctaaaattcaccaatgagaacattactcaaatgttaaccaatttgagtgaaggcaaggcagatttcaagatttttgacgctccaacggttaacgccattattaaaaatcaagggttagataatctcaaaacaattgaactcacctcaacagagcaaccatttatttattttatctttagtcaagatcaagagaaattgcaaagctttgttaacaagcgtattaaagagttgactgctgatggaactcttagcaagcttgccaaagagcaccttggcggtgattacgtgccatcagataaagagttgaaacttcctacagctaac

SEQ ID NO: 705 - DNA, 921 bp, Streptococcus pyogenes
ttgaaactaacattaaatcgcatcctcttttcaggactagcactgtcaattctactcaccttgacaggctgtgtgggaagagacgctcacggaaatcccaaaggtatgatttgggaatttcttggaaaacccatgtcatactttatcgattactttgcaaacaatgctggactaggttatggactggctatcatcatcgtaaccattattgttagaacacttatcttaccactaggtctatatcaatcttggaaagcaagttatcaatctgagaaaatggccttcttgaaacctgtttttgaaccaatcaacaaacgtatcaaacaggcaaatagtcaggaagaaaaaatggctgcccaaacagaattaatggctgctcagcgtgctcatgggattaaccctcttggaggtattggatgtctacctcttctcatccagatgccattcttttctgccatgtattttgccgctcaatacactaaaggagtatcaacaagcacctttatgggtattgatcttggtagccgtagtttagtgttaacagcaattatcgctgctctttacttcttccaatcatggttatcaatgatggccgtttcagaagaacaacgtgagcaaatgaagacgatgatgtacaccatgcctatcatgatgatcttcatgtccttctcactccctgctggtgttggtctttactggctagttggtggtttctttagtattattcaacagttaatcacaacctacctcttaaaacctcgattgcataagcaaattaaagaagaatacgctaaaaacccgcctaaagcataccaatcaacttcttctcgtaaggacgttacgccttcacaaaacatggaacaggctaacttgcctaaaaaaataaaatccaatcgtaatgctggaaaacagcgaaagcgt

SEQ ID NO: 706 - DNA, 930 bp, Streptococcus pyogenes
atgaaaaaattaactctactattaacactctgtttgacaactattaccttaatcgcctgtggtaatcaagcaactaatcattctaacaccgcctcaaaaagtttatcgcctatgcctcaaattgctggtgtgacttattacggagatattcctaaacagcctaagcgagtagtcagtctggcttcaacttacactggttacctcaaaaaattagatatgaatctagtcggggttacttcttatgacaagaaaaaccccatcttagcaaagactgtaaaaaaagcaaagcaagttgctgcaactgatttagaagccgttacaacgcttaagcctgacctcattgttgttggctctacagaagaaaatattaaacaattggcagaaattgcgcctgttatctcgattgaataccgcaaacgtgattatttacaagtgttatctgacttcggccgcatctttaacaaagaagacaaagccaagaagtggttaaaagattggaaaactaaaacagcagcttatgaaaaagaagtcaaggccgttacaggtgacaaagcaacctttactattatggggctttatgaaaaagacgtttacctttttggtaaagactggggacgtggcggagagattatccatcaagctttccattatgatgctcctgaaaaagtgaagactgaagtttttaaacaaggttacctgtcattgtcgcaggaagtcttgccagactatattggtgattatgtcgtcgttgctgcagaagatgataagactggttctgctctatatgaaagcaagctatggcaatccattccagctgtgaaaaaacaccatgtgatcaaagtcaatgccaatgttttttactttactgatcctctttctttagaatatcaattagagactttacgagaggcaatcttatcaagtgaaaac

SEQ ID NO: 707 - DNA, 4941 bp, Streptococcus pyogenes
gtggagaaaaagcaacgtttttcccttagaaaatacaaatcaggaacgttttcggtcttaataggaagcgttttcttggtgatgacaacaacagtagcagcagatgagctaagcacaatgagcgaaccaacaatcacgaatcacgctcaacaacaagcgcaacatctcaccaatacagagttgagctcagctgaatcaaaatctcaagacacatcacaaatcactctcaagacaaatcgtgaaaaagagcaatcacaagatctagtctctgagccaaccacaactgagctagctgacacagatgcagcatcaatggctaatacaggttctgatgcgactcaaaaaagcgcttctttaccgccagtcaatacagatgttcacgattgggtaaaaaccaaaggagcttgggacaagggatacaaaggacaaggcaaggttgtcgcagttattgacacagggatcgatccggcccatcaaagcatgcgcatcagtgatgtatcaactgctaaagtaaaatcaaaagaagacatgctagcacgccaaaaagccgccggtattaattatgggagttggataaatgataaagttgtttttgcacataattatgtggaaaatagcgataatatcaaagaaaatcaattcgaggattttgatgaggactgggaaaactttgagtttgatgcagaggcagagccaaaagccatcaaaaaacacaagatctatcgtccccaatcaacccaggcaccgaaagaaactgttatcaaaacagaagaaacagatggttcacatgatattgactggacacaaacagacgatgacaccaaatacgagtcacacggtatgcatgtgacaggtattgtagccggtaatagcaaagaagccgctgctactggagaacgctttttaggaattgcaccagaggcccaagtcatgttcatgcgtgtttttgccaacgacatcatgggatcagctgaatcactctttatcaaagctatcgaagatgccgtggctttaggagcagatgtgatcaacctgagtcttggaaccgctaatggggcacagcttagtggcagcaagcctctaatggaagcaattgaaaaagctaaaaaagccggtgtatcagttgttgtagcagcaggaaatgagcgcgtctatggatctgaccatgatgatccattggcgacaaatccagactatggtttggtcggttctccctcaacaggtcgaacaccaacatcagtggcagctataaacagtaagtgggtgattcaacgtctaatgacggtcaaagaattagaaaaccgtgccgatttaaaccatggtaaagccatctattcagagtctgtcgactttaaagacataaaagatagcctaggttatgataaatcgcatcaatttgcttatgtcaaagagtcaactgatgcgggttataacgcacaagacgttaaaggtaaaattgctttaattgaacgtgatcccaataaaacctatgacgaaatgattgctttggctaagaaacatggagctctgggagtacttatttttaataacaagcctggtcaatcaaaccgctcaatgcgtctaacagctaatgggatggggataccatctgctttcatatcgcacgaatttggtaaggccatgtcccaattaaatggcaatggtacaggaagtttagagtttgacagtgtggtctcaaaagcaccgagtcaaaaaggcaatgaaatgaatcatttttcaaattggggcctaacttctgatggctatttaaaacctgacattactgcaccaggtggcgatatctattctacctataacgataaccactatggtagccaaacaggaacaagtatggcctctcctcagattgctggcgccagccttttggtcaaacaatacctagaaaagactcagccaaacttgccaaaagaaaaaattgctgatatcgttaagaacctattgatgagcaatgctcaaattcatgttaatccagagacaaaaacgaccacctcaccgcgtcagcaaggggcaggattacttaatattgacggagctgtcactagcggcctttatgtgacaggaaaagacaactatggcagtatatcattaggcaacatcacagatacgatgacgtttgatgtgactgttcacaacctaagcaataaagacaaaacattacgttatgacacagaattgctaacagatcatgtagacccacaaaagggccgcttcactttgacttctcactccttaaaaacgtaccaaggaggagaagttacagtcccagccaatggaaaagtgactgtaagggttaccatggatgtctcacagttcacaaaagagctaacaaaacagatgccaaatggttactatctagaaggttttgtccgctttagagatagtcaagatgaccaactaaatagagtaaacattccttttgttggttttaaagggcaatttgaaaacttagcagttgcagaagagtccatttacagattaaaatctcaaggcaaaactggtttttactttgatgaatcaggtccaaaagacgatatctatgtcggtaaacactttacaggacttgtcactcttggttcagagaccaatgtgtcaaccaaaacgatttctgacaatggtctacacacacttggcacctttaaaaatgcagatggcaaatttatcttagaaaaaaatgcccaaggaaaccctgtcttagccatttctccaaatggtgacaacaaccaagattttgcagccttcaaaggtgttttcttgagaaaatatcaaggcttaaaagcaagtgtctaccatgctagtgacaaggaacacaaaaatccactgtgggtcagcccagaaagctttaaaggagataaaaactttaatagtgacattagatttgcaaaatcaacgaccctgttaggcacagcattttctggaaaatcgttaacaggagctgaattaccagatgggcattatcattatgtggtgtcttattacccagatgtggtcggtgccaaacgtcaagaaatgacatttgacatgattttagaccgacaaaaaccggtactatcacaagcaacatttgatcctgaaacaaaccgattcaaaccagaacccctaaaagaccgtggattagctggtgttcgcaaagacagtgtcttttatctagaaagaaaagacaacaagccttatacagttacgataaacgatagctacaaatatgtctcagtagaagacaataaaacatttgtggagcgacaagctgatggcagctttatcttgccgcttgataaagcaaaattaggggatttctattacatggtcgaggattttgcagggaacgtggccatcgctaagttaggagatcacttaccacaaacattaggtaaaacaccaattaaacttaagcttacagacggtaattatcagaccaaagaaacgcttaaagataatcttgaaatgacacagtctgacacaggtctagtcacaaatcaagcccagctagcagtggtgcaccgcaatcagccgcaaagccagctaacaaagatgaatcaggatttctttatctcaccaaacgaagatgggaataaagactttgtggcctttaaaggcttgaaaaataacgtgtataatgacttaacggttaacgtatacgctaaagatgaccaccaaaaacaaacccctatctggtctagtcaagcaggcgctagtgtatccgctattgaaagtacagcctggtatggcataacagcccgaggaagcaaggtgatgccaggtgattatcagtatgttgtgacctatcgtgacgaacatggtaaagaacatcaaaagcagtacaccatatctgtgaatgacaaaaaaccaatgatcactcagggacgttttgataccattaatggcgttgaccactttactcctgacaagacaaaagcccttgactcatcaggcattgtccgcgaagaagtcttttacttggccaagaaaaatggccgtaaatttgatgtgacagaaggtaaagatggtatcacagttagtgacaataaggtgtatatccctaaaaatccagatggttcttacaccatttcaaaaagagatggtgtcacactgtcagattattactaccttgtcgaagatagagctggtaatgtgtcttttgctaccttgcgtgacctaaaagcggtcggaaaagacaaagcagtagtcaattttggattagacttaccggtccctgaagacaaacaaatagtgaactttacctaccttgtgcgggatgcagatggtaaaccgattgaaaacctagagtattataataactcaggtaacagtcttatcttgccatacggcaaatacacggtcgaattgttgacctatgacaccaatgcagccaaactagagtcagataaaatcgtttcctttaccttgtcagctgataacaacttccaacaagttacctttaagataacgatgttagcaacttctcaaataactgcccactttgatcatcttttgccagaaggcagtcgcgttagccttaaaacagctcaagatcagctaatcccgcttgaacagtccttgtatgtgcctaaagcttatggcaaaaccgttcaagaaggcacttacgaagttgttgtcagcctgcctaaaggctaccgtatcgaaggcaacacaaaggtgaataccctaccaaatgaagtgcacgaactatcattacgccttgtcaaagtaggagatgcctcagattcaactggtgatcataaggttatgtcaaaaaataattcacaggctttgacagcctctgccacaccaaccaagtcaacgacctcagcaacagcaaaagccctaccatcaacgggtgaaaaaatgggtctcaagttgcgcatagtaggtcttgtgttactcggacttacttgcgtctttagccgaaaaaaatcaaccaaagat

SEQ ID NO: 708 - DNA, 555 bp, Streptococcus pyogenes
atgaaatggagtggttttatgaaaacaaaatcaaaacgctttttaaacctagcaaccctttgcttggccctactaggaacaactttgctaatggcacatcccgtacaggcggaggtgatatcaaaaagagactatatgactcgcttcgggttaggcgatttagaagatgattcagctaactatccttcaaatttagaagctagatataaaggatatttagagggatatgaaaaaggcttaaaaggagatgatatacccgaacggcccaagattcaggttcctgaggatgttcagccatctgaccatggcgactatagagatggttatgaggaaggatttggagaaggacaacataaacgtgatccattagaaacagaagcagaagatgattctcaaggaggacgtcaagaaggacgtcaaggacatcaagaaggagcagattctagtgatttgaacgttgaagaaagcgacggtttgtctgttattgatgaagtagttggagtaatttatcaagcatttagtactatttggacatacttaagcggtttgttctaa

SEQ ID NO: 709 - DNA, 696 bp, Streptococcus pyogenes
atgaaaagaataataaaaacaataattttagttataataatctttcatgggtacggaagtgtaaaatcagatagtgaaaatattaaagacgttaagctacaattaaattacgcatacgaaatcataccagtagattatacgaattgtaatattgattacttgactactcatgatttttatattgatatttccagttataaaaagaaaaatttttcagttgattctgaggtcgagagctatattacaacaaagtttacgaaaaatcaaaaagtaaatatttttggtcttccgtacatatttactcgttatgatgtttattatatatatggtggggttacaccatcagtaaacagtaattcggaaaatagtaaaattgtaggtaatttactaatagatggagtccagcaaaaaacactaataaatcccataaaaatagataaacctatttttacgattcaagaatttgacttcaaaatcagacaatatcttatgcaaacatacaaaatttatgatcctaattctccatacataaaagggcaattagaaattgcgatcaatggcaataaacatgaaagttttaacttatatgatgcaacctcatctagtacaaggagtgatatttttaaaaaatataaagacaataagactataaatatgaaagatttcagccattttgatatttacctttggactaaa

SEQ ID NO: 710 - DNA, 957 bp, Streptococcus pyogenes
atgaaattagcggttttggggacaggtatgattgttaaggaagttttgcctgtcttgcagaaaattgatggtattgatttagttgctatcttatcaacagttagaagtttaacgacagctaaagacctcgctaaggcacatcacatgcctctagctacgagtaaatatgaggctatcttaggcaatgaggagattgacacggtttatattggactgccgaatcacctgcattttgcctatgctaaggaggcccttctagctggcaaacatgtcatttgtgaaaagccctttaccatgacagcaggagaattagatgaactggtggtaatcgctagaaaacgaaaactcattttgttagaagcgattacgaatcagtacctgagtaacatgacctttatcaaagagcatcttgaccaacttggcgatatcaaaattgtagaatgcaattattcacaatattcttcacgctacgatgccttcaaacgaggtgatatcgcgccagcttttaatcctaaaatgggtggtggagctttacgtgatttaaacatctacaacattcattttgtggtagggttatttggtcgccctaaaacggttcaatatttagccaatgtcgaaaaaggcattgacacctcaggcatgcttgtcatggactatgagcagtttaaagtggtgtgtatcggggccaaagactgcactgcagaaatcaaatcaaccatccaaggtaacaaagggtcactggcagtgcttggagcaacaaataccctccctcaggttcagttaagtctacacggtcacgaaccacaagtgattaaccacaacaagcatgaccaccggatgtatgaagagtttgtcgcttttagggacatgattgaccaaagagactttgagaaagtgaatcaggctttggaacatagccgagctgtcatggctgtgttggagcgcgctgttcattcg

SEQ ID NO: 711 - DNA, 804 bp, Streptococcus pyogenes
atgaaaaaattattatctctcagtttagtagccattagtttacttaatttgagtgcttgtgaatctgttgaccgcgctataaaaggcgataaatacattgatgaaaaaactgccaaagaagaaagcgaagcagcttctaaagcctatgaagaaagcattcaaaaagctctcaaagctgatgctagccaatttccacaactaaccaaagaagtcggcaaagaagaagctaaggtcgtaatgaggacaagtcaaggggacattacccttaagttattcccaaaatatgctcccttagctgttgagaacttcctcacccatgctaaaaaaggctactatgataaccttaccttccatcgtgtgatcaacgactttatgattcaatcaggtgaccccaaaggagatggcacaggtggtgaatcgatttggaaaggcaaggatcctaaaaaagatgctggcaatggctttgtcaacgaaatctctccatttttatatcatattcgcggtgctcttgccatggcaaatgctggtgctaatactaacggtagccaattttatatcaaccaaaacaagaaaaatcaaagcaagggattatcaagtaccaactacccaaaacctatcatctctgcctatgagcatggcggcaatccaagcttagatggcggttatactgtatttggtcaagtcattgatggtatggatgttgtcgataaaattgccgctacttctatcaaccaaaatgataaaccagaacaagacattacgattacctcaattgacattgtcaaagattatcgctttaaaaac

SEQ ID NO: 712 - DNA, 1167 bp, Streptococcus pyogenes
atgattattactaaaaagagcttatttgtgacaagtgtcgctttgtcgttagtacctttggcgacagcgcaggcacaagagtggacaccacgatcggttacagaaatcaagtctgaactcgtcctagttgataatgtttttacttatactgtaaaatacggtgacactttaagcacaattgctgaagcaatggggattgatgtgcatgtcttaggagatattaatcatattgctaatattgacctaatttttccagacacgatcctaacagcaaactacaatcaacacggtcaggcaacgaatttgacggttcaagcacctgcttctagtccagctagcgttagtcatgtacctagcagtgagccattaccccaagcatctgccacctctcaaccgactgttcctatggcaccacctgcgacaccatctgatgtcccaacgacaccattcgcatctgcaaagccagatagttctgtgacagcgtcatctgagctcacatcgtcaacgaatgatgtttcgactgagttgtctagcgaatcacaaaagcagccagaagtaccacaagaagcagttccaactcctaaagcagctgaaacgactgaagtcgaacctaagacagacatctcagaagccccaacttcagctaataggcctgtacctaacgagagtgcttcagaagaagtttcttctgcggccccagcacaagccccagcagaaaaagaagaaacctctgcgccagcagcacaaaaagctgtagctgacaccacaagtgttgcaacctcaaatggcctttcttacgctccaaaccatgcctacaatccaatgaatgcagggcttcaaccacaaacagcagccttcaaagaagaagtggcttctgcctttggtattacgtcatttagtggttaccgtccaggtgatccaggagatcatggtaaaggtttggccattgattttatggtgcctgaaaattctgctcttggtgatcaagttgctcaatatgccattgaccatatggcagagcgtggtatttcatacgttatttggaaacagcgattctatgcgccatttgcaagtatttacggaccagcctacacatggaaccccatgccagatcgcggcagtattacagaaaaccattatgatcatgttcatgtctcctttaatgct

SEQ ID NO: 713 - DNA, 705 bp, Streptococcus pyogenes
atgaaaaagattaacatcatcaaaatagttttcataattacagtcatactgatttctactatttcacctatcatcaaaagtgactctaagaaagacatttcgaatgttaaaagtgatttactttatgcatacactataactccttatgattataaaaattgcagggtaaatttttcaacgacacacacattaaacattgatactcaaaaatatagagggaaagactattatattagttccgaaatgtcttatgaggcctctcaaaaatttaaacgagatgatcatgtagatgtttttggattattttatattcttaattctcacaccggtgagtacatctatggaggaattacgcctgctcaaaataataaagtaaatcataaattattgggaaatctatttatttcgggagaatctcaacagaacttaaataacaaaattattctagaaaaagatatcgtaactttccaggaaattgactttaaaatcagaaaataccttatggataattataaaatttatgacgctacttctccttatgtaagcggcagaatcgaaattggcacaaaagatgggaaacatgagcaaatagacttatttgactcaccaaatgaagggactagatcagatatttttgcaaaatataaagataatagaattatcaatatgaagaactttagtcatttcgatatttatcttgaaaaa

SEQ ID NO: 714 - DNA, 1545 bp, Streptococcus pyogenes
atgaaaaagaaaattcttttaatgatgagtttaatcagtgtcttttttgcttggcaacttactcaggcaaaacaagtcttagcagagggtaaagtgaaggtggtgacaactttctatcctgtttatgaatttacaaaaggggttattggtaatgatggcgatgttttcatgcttatgaaagcaggaacggaacctcatgattttgagccttctacaaaagacattaaaaaaatccaagatgcagatgcatttgtttatatggatgacaatatggaaacttgggtttctgatgtgaaaaaatcattgacatctaaaaaagtgaccatcgtcaagggaactggtaacatgctcttggtagcaggagctggacatgaccatccccatgaggatgctgacaaaaagcatgagcataataaacatagcgaagaaggacacaaccatgcttttgacccacacgtgtggttgtcaccataccgtagcattacagtcgttgaaaatattcgcgacagtctttcaaaagcttacccagaaaaagcagagaacttcaaagccaatgccgctacttatattgaaaaattaaaagagcttgacaaagactatacggcagcactttcagatgctaagcaaaagagctttgtgacacaacacgcagcttttggttatatggcacttgactatggcttgaaccaaatttctattaatggtgtcacaccagatgcagaaccatcagcaaaacgtattgctactttgtcaaaatacgttaaaaaatatggcatcaaatacatttattttgaggaaaatgcgtcaagtaaagtcgcaaaaaccctagctaaagaagcaggagttaaagcggctgtgcttagtccgcttgaaggtttgactgaaaaagagatgaaagctggccaagattactttacggtcatgcgtaaaaaccttgaaaccttacgcttaaccactgatgtggctggtaaagaaattcttccagaaaaagacacgactaagacagtttacaatggttatttcaaagacaaagaagtcaaagatcgtcaattatctgactggtcaggtagctggcaatctgtttacccctatctacaagatggtactttagaccaagtttgggactacaaggctaaaaaatctaaaggtaaaatgacagcagccgagtacaaagattactacactactggttataaaactgacgtggaacaaatcaaaatcaatggtaagaaaaagaccatgacctttgttcgtaatggtgaaaagaaaaccttcacttacacatacgccggcaaagaaatcttgacctatccaaaaggaaatcgcggggttcgtttcatgtttgaagctaaagaagcagatgctggcgaattcaaatacgttcaattcagtgaccatgccattgctcctgaaaaagcaaagcatttccacctgtactggggtggtgacagccaagaaaaattacataaagagttagaacattggccaacttactacggttcagacttatctggtcgtgaaatcgcccaagaaatcaatgctcat

SEQ ID NO: 715 - DNA, 6177 bp, Streptococcus pyogenes
atgtttttaaaacaccaagatgtgaaacaaaaaaattggagaatgcgtaaggtcaaaaaagtctttgttagttcatgtatgcttttaacagtgggcctcggagttgccgtacctactggattcagccaatctaatggcgtgatggttgtaaaggctgcggaagtgccggcgacagatttatcacgtcaggcgtctgattcggagagggtagatgaatcgtctttattgcagaaagaaaacttatcagtagattcatttaaattagaaaatttaaatggatgggaagctgaaaatgatacagcaggtaatttggggaaatttaaagatccagatagttcgggctatcaaaatattttgacatcatctggaaagaatatcagtgtagctgttgctcccaaaggttcaggtaaaatgaacattaaagtaactaaaagatcaaattttcagggtggatattatgtaggtggtcttagaactcaaactccggtattgaagttaaatgatgtttatcgatattcttttacaactaaaaaattatcaggaaattcttcagagttcaaaacgagagttaagcccgttgaatctaataataaactagggaaagagcttgttattagggtggataataaaaatgtatctactaagcatgattggcttccagacatctctgatggaactcatactgtggacttcactggtcttgataaaaaattatctgttgctttcagattttctccaagacaaacttcgaatgttgtttacgaattttctaacataaatataaaaaacattagtcctgcatcagtgccggctattccttcgaaagttttagagggaaccagcgtcttgtcgggtactgcaatatcttctggagatacattagaaaaaagaaaatcgtttgatggcgatatcctaagagtttataaagatagcaaaatcattgctagaacagtaataaaaggcaataagtgggatgttaaactttcaaagcctcttattgcaggtgaaaaattagattttgagattttgcatccgagatctcaaaacgttagtaaaaaaatttcaaaacaagtcgaagctaaaccatttgatccagcttcctataaagaaaaagttatagccaaattaaagccggtttatgaagctactagtgaaaaaatcacaaatgatgcttggttggatgaaaatgcgaaggatttgcaaaaacaaaaattagaagaacaatatatttctggaaaagtagcgatatcagaggctggaactaaacaagaagctatagatgcagcatataataaatattcaagtcaaacagatccagactctcttcctagtcagtataaacaaggtaataaagaaaatgaacaagaaaaagggcgtcaagatttaatccagactcgtgatctgacgttgaaagccattcaagaagacaaatggctaacagagcaggagaaaacaattcaaaaagaagaagcattaaaagcttttgaaactggtatagaaagtgttaatcaaacagtatcattagaacagttgaagcaacggttaatagtgtataaagcttctgaaaaagattcagagaaaaaagaatatcctgagtcaattcctaatcagcatattccagggaaagaaaaagaagttaaagctgctaaacaagaagaacttaaaaaattacatgacacaactcttgaaaaaatcaatcaagataaatggttgacgccagaccaacaagctgaacagttaaaacaagcggaagttacttttaaaaaaggccaagaagcaattaaaagtgctcagactttaactcagcttgagacagacttagctgattatgtttctgagaatgaaggtaagggaaattctattcccgataaatacaaatctggcaataaagatgatttggtaaataaggctgaagttaaacttaaggaagctcacgaagctactaaacaagcaattgaaaaagatccatggttgagtccggaacagaaaaaagctcaaaaagaaaaagccaaagcaagactagatgagggcttgaaagctcttaaagctgcagatagtttagagattcttaaagtgacagaagaagctttcgttgataaagaaaaaaatccagattcaattccaaatcaacataaagctggaactgctgatcaagctagaaaacaagctttagatagtttagataaggaggttcaaaaagagttagagtcaattgataacgataatactctaacaactgatgagaaagcagctgctaagaaaaaagtcaatgacgcttatgatgtagctaagcaaacagctatggaagccaattcttatgaagatttgactactattaaagatgagttcttatctaatttacctcataaacaaggaacgccgcttaaagatcaacaatctgatgctattgcagaattagagaagaagcagcaagaaattgaaaaagctattgagggtgataaaacattaccaagagacgaaaaagagaaacaaattgctgactctaaggaacgcttaaaatctgacacgcaaaaagttaaagatgctaaaaatgctgatgctattaaaaaagcatttgaagaagggaaagtgaatattcctcaagcacatatcccaggtgatttgaacaaggataaagaaaaacttcttgcagaattgaagcaaaaagcagatgatactgaaaaagctattgatgttgataaaactctgacagaagatgagaaaaaagagcaaaaagtcaaaacaaaagctgaacttgaaaaagctaaaactgatgttaaaaatactcagacacgtgaagaactagataaaaaagttccagaacttaagaaagctattgaagacactcacgttaaaggtaatcttgaaggtgttaagaataaggctattgaagatcttaaaaaagctcatactgaaacagttgctaaaataaatggtgatgatacccttgacaaagctactaaagaagctcaagtgaaagaagctgacaaagctttggcagcaggtaaagatgcgatcactaaagcagatgatgctgataaagtaagtacagctgttacagagcacacaccaaaaattaaagcagcacataaaactggtgaccttaaaaaagctcaagtagatgctaacacagctcttgacaaagcagctgaaaaagaacgtggagaaatcaataaagatgctacactaacgacagaagataaagcaaaacaactgaaagaagttgagacagctcttactaaagctaaagataacgtgaaagctgctaagacagcagacgctatcaatgacgcacgtgataaaggcgtagcaacaattgatgccgtccataaagcaggtcaagacttaggtgctcgtaagtcaggtcaagtcgctaaacttgaagaagcagctaaagcaacgaaagacaagatttcagctgatccaactttgacaagcaaagaaaaagaagagcaatctaaagctgttgacgctgaacttaagaaagcgatagaagctgttaacgcagctgacacagctgacaaggttgacgatgctcttggtgaaggtgttacagacatcaagaaccaacacaagtcaggtgactctatcgacgctcgtcgtgaggctcatggtaaggaacttgatagagtcgctcaagaaactaaaggtgcgattgaaaaagaccctactttgacgactgaagaaaaagctaaacaagttaaagacgtagatgccgctaaagaaagaggcatggctaagcttaatgaagctaaagatgctgatgctttagacaaagcttacggtgaaggtgttacagacatcaagaaccaacacaagtcaggtgaccctgtcgacgctcgtcgtggattacacaacaagtcaatcgacgaagtggcgcaagcaactaaggacgctatcacagcagatacgactttgactgaagctgaaaaagaaacacaacgtggcaatgttgataaagaagcaactaaagctaaagaagaacttgctaaggctaaagatgctgatgctttagacaaagcgtacggtgacggtgtaaccagcatcaagaaccaacacaagtcaggtaaaggtcttgacgttcgtaaagatgagcacaagaaagctcttgaagctgttgctaaacgtgtcactgctgaaattgaggctgatccaaccttaacaccagaagtgagagaacaacaaaaagcagaggttcaaaaagagcttgaacttgcgactgataagattgctgaagctaaagatgcagatgaagcagacaaagcttacggtgacggtgtcacagcgatcgaaaatgcccacgttattggtaaaggtatcgaagctcgtaaagaccttgctaagaaagaccttgctgaagctgctgctaagacaaaagctctcattattgaagacaaaacgcttactgatgatcaacgtaaagaacagttattaggtgttgatacagagtatgctaaaggtatcgagaatattgatgcagctaaggatgctgcaggtgttgataaagcatatagtgacggtgttcgtgacatcctggcacagtacaaagaaggtcaaaaccttaatgatcgtcgtaatgctgccaaagaatttcttcttaaagaagcagacaaagtgacgaaactaatcaatgatgatccaaccttgactcatgaccaaaaagttgatcaaatcaacaaagttgaacaagctaagttagacgcaatcaagtctgttgatgatgctcaaacagctgatgctatcaatgatgctcttggtaagggtattgaaaacatcaacaaccaataccaacatggcgatggcgttgatgttcgtaaagcgactgccaaaggcgatcttgaaaaagaagctgctaaagtgaaagctcttattgctaaggatccgaccttaactcaagctgataaagacaaacaaacagcagcggttgacgcagctaagaatacagcaattgcagcggttgataaagcgacaacaactgaaggcattaaccaagaacttggtaaaggcatcacagctatcaataaagcttaccgtccaggtgaaggtgttaaagcacgtaaagaagccgctaaagctgatcttgaaaaagaagctgctaaagtgaaagctcttattactaacgacccaaccttaacaaaagctgataaagctaaacaaacagaagctgttgctaaagcccttaaagctgctatcgcagcggttgataaagcgacaacagctgaaggcattaaccaagaacttggtaaaggcatcacagctatcaataaagcttaccgtccaggtgaaggtgttaaagcacgtaaagaagccgctaaggctgatcttgaaagagaagctgctaaggttcgtgaagctatcgctaacgacccaaccttaacaaaagctgataaagctaaacaaacagaagctgttgctaaagctcttaaagctgctatcgcagcggttgataaagcgacaacagctgaaggcattaaccaagaacttggtaaaggcatcacagctatcaacaaagcttaccgtccaggtgaaggtgttgaagcacataaagaagctgctaaagctaatcttgaaaaagtagctaaagaaactaaagctcttatttcaggagaccgttacttgagcgaaactgaaaaagcagtccaaaaacaagctgttgagcaagctcttgcgaaagcacttggtcaagttgaggctgctaagacagttgaagctgttaagttggcagaaaaccttggtactgtagctatccgttcagcatatgttgctggtttagctaaagatactgatcaagcaacagctgctcttaacgaagcgaaacaagctgctattgaagctcttaaacaagctgcggcagaaacacttgctaagattacaactgatgctaaattgactgaagctcaaaaagctgaacaatcagaaaatgtatcattagcgcttaagacggctattgcgactgttcgttcagcacaatctattgcgtctgtgaaagaagcaaaagataaaggtattactgctatccgtgcagcctatgtgcctaataaggcagtcgcaaaatcatcgtcagcgaaccatcttccaaaatcaggtgatgcaaactcaattgttcttgttggcttaggagttatgtctcttcttttaggtatggtgctttatagcaagaaaaaagaaagtaaagac

SEQ ID NO: 716 - DNA, 810 bp, Streptococcus pyogenes
atgaattttaaaaaaataagatttggttttttgctttgcctcctactttatcctttagcagcttgtaacaagtctgaacaacttaatcactacgaaagaattaaaaaaacaagaaaattagtcgttgctgtaagccctgattatgctccttttgaatttaaagctttagttaatggaaaagatactattgttggagcagatgttcaattagctcaggctattgctgatgaattagacgttgatcttgagctttcaccaatgagttttgataatgttttgtctagtttacagactggtaaagctgatcttgctatttcaggaatctcacatactaaagaaagagctaaagtatatgatttttcaattccttactatcaggcagaaaacgctatagtgatgagagcatctgatgctaaagtgaccaaaaatattagtgacctaaacggtaagaaagtagccgctcaaaaaggtagtatcgaggaaggtttagttaaaatacaattaccaaaggccaatctgatttctttgactgctatgggagaagccattaatgaactaaaagcaggacaagtctatgcagttaccttagaagcacctgtagctgctggttttttagcccaacataaggatctggctttagcaccctttagcttaaaaaccagtgatggagatgccaaagcagtggcccttcctaaaaatagtggagacttaaccaaagccgttaataaggttattgctaagttagatgagcaagaacggtacaagtcatttattgcagagacaatagcactaacgaaaaatactatgaag

SEQ ID NO: 717 - DNA, 801 bp, Streptococcus pyogenes
atgaattttttaacaaagaaaaaccgtattttactgagagaaatggtaaaaacggattttaaattacgctatcaagggagcgcaattggctatctatggtctatcttaaaaccgcttatgatgtttacgattatgtacttggtatttattcgttttcttcgcctgggtggaaatgtacctcattttccagtagcgcttttattggcaaatgtcatctggtcttttttttcagaagcaactagcatgggaatggtatctattgtatctcggggagacttgttgcgaaaattgaacttttctaagcacatcattgttttttcggcagtgttaggagctttaattaattttcttattaatttggttgttgttttaatttttgcgttgataaatggtgtgactatatcagggtatgcttatctctctctttttctttttatagaattagttgttttagtgcttggaattgcattgttattgtcgaatgtctttgtttattatcgtgacttagctcaagtctgggaagtactattacaagcaggtatgtatgccactccaatcatttatccgatcacttttgttttagatagccaccctttggcggcaaagttgttgatgctaaatccagtagcacaaatgattcaagattttcgttatttattgattgacagggccaacgtaacgatttggcagatgtcaaccaattggttttacattgttattccatatttagtaccatttgttatattatttattggcatctttgtctttaagaaaaatgccgatagatttgcggagattatt

SEQ ID NO: 718 - DNA, 861 bp, Streptococcus pyogenes
atgaagaaatcagttacattactgtctatcggacttgccagccttttattggcagcatgtgcgccacatcaatctcaaaaatcaagttgggacactatcaaagaaaaaggggtgttaaaagtagctaccccaggaacctatcagccaacttctttttacaacgataataatgagttagtaggttacgaagtagatatggtcaaagaaatcggtaaacgacttaacattaaagtcaagtttgttgaaacaggatttgaccaagcctttacctcagttgatagtggtcgagtggatatttctttgaacaactttgacattaccccaaaacgtcagaaaaaatacaatatctctacgccttataaatacggggtaggaggcatgattgtccgtgctgatggcagctcaaacatagctaaaaaagatcttagcgactggaaaggaaaaaaagcagccggcgcttctggaacagaatacatgaaagtagcgcaaaaacagggagctgaactggtgacctacgataatgttacaggagatgtttatctaaacgatgtggctaacggtcgaacagatttcatcccaaatgattacccagctcaaaaattatttgtggattacatgttatctcaaaatccaaatctaaatgtcaaaatgagcgatgttcagtacaacccaaccgaacaaggaattgttatgaacaaaaaagacgatagcctcaagaaaaaaatagatgctgttattaaagacatgataaaagatggtagcttgaagaaaatctctgaaacctactatgctggtcaagatctgacaaaaccttttggcaaagacaaaaaaattcccgtcattgatacgaaagacgttaac

SEQ ID NO: 719 - DNA, 708 bp, Streptococcus pyogenes
atgagatataattgtcgctactcacatattgataagaaaatctacagcatgattatatgtttgtcatttcttttatattccaatgttgttcaagcaaattcttataatacaaccaatagacataatctagaatcgctttataagcatgattctaacttgattgaagccgatagtataaaaaattctccagatattgtaacaagccatatgttgaaatatagtgtcaaggataaaaatttgtcagttttttttgagaaagattggatatcacaggaattcaaagataaagaagtagatatttatgctctatctgcacaagaggtttgtgaatgtccagggaaaaggtatgaagcgtttggtggaattacattaactaattcagaaaaaaaagaaattaaagttcctgtaaacgtgtgggataaaagtaaacaacagccgcctatgtttattacagtcaataaaccgaaagtaaccgctcaggaagtggatataaaagttagaaagttattgattaagaaatacgatatctataataaccgggaacaaaaatactctaaaggaactgttaccttagatttaaattcaggtaaagatattgtttttgatttgtattattttggcaatggagactttaatagcatgctaaaaatatattccaataacgagagaatagactcaactcaatttcatgtagatgtgtcaatcagc

SEQ ID NO: 720 - DNA, 2415 bp, Streptococcus pyogenes
gtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaa

SEQ ID NO: 721 - DNA, 954 bp, Streptococcus pyogenes
atgaaacgatttttaaatagtcgtccttggttaggaatggtatcagtcttttttgcgattctcctttttttaactgcagcatcgagcaatcataataactctagctcgcaaatttatagtccgattgaaacctatacgcatagccttaaagatgtaccaattgatatgaagtatgatagtgacaaatattttatcagtgggtattcttatggtgcggaagtttatctaacctccactaatcgtatcaaattagattctgaagtgaacaatgatacacgtaattttaagattgtggcggatctaacacatagtcatccaggtacagtaagtgtcaacctaagagtagaaaaccttccttctggggtgacagctaccgtatctccagataaaatatcagtcacaattggcaaaaaagaatctaaggtatttcctgttagaggaagcgttgatgctaaacaaattgcaaatggttatgaaattagcaaaattgaaacgggggttaataaggttgaagtgaccagtgatgaatctaccattgctttaattgatcacgttgtggcaaagttacctgatgatcaagtgttagataggaattatagtagtcgagtgaccttacaagctgtctcagctgatggaactattttagcaagtgcaattgatcctgcaaaaacaaatttatcagttgctgtaaaaaaaataacgaaatcagtcccgattagagttgaggcagtggggatgatggatgatagcttatcagatattcaatacaaattgtcaaaacaaacagctgttatctcaggtagtcgagaggtcttagaagatattgatgaaattattgcagaagttaacatttctgatgtcactaaaaatactagtaagaccgtgagtttgtcttctagtcaggtgtcaattgagccgtcagtagtgaccgttcagttgacaaccaccaaaaaa

SEQ ID NO: 722 - DNA, 879 bp, Streptococcus pyogenes
ttgctgacctttggaggtgcaagtgcggttaaggcggaagaaaatgaaaaagtaagagagcaagaaaagctcatacagcaactttctgaaaagctagtggaaattaatgacttacaaactttaaatggtgataaagagagtatacagtctctcgtagattatctgactcgaagaggaaaacttgaagaagaatggatggaatatttgaattctggtattcaacgcaaactttttgttggtccaaaaggacctgcaggtgaaaaaggagaacaaggtcctactggaaaacaaggcgagcgtggtgagaccggccctgcaggtccacgtggtgacaagggcgaaactggtgacaaaggagcccagggtccagtaggtcccgctggcaaggacggccaaaacggtaaagatggtcttccaggtaaagacggcaaggacggccaaaacggtaaagatggtcttccaggtaaagacggcaaggacggccaagacggtaaagatggcctcccaggtaaagacggtaaggatggccaaaatggcaaagatggtcttccaggtaaagacggtcaaccaggtaaaccagctcctaaaacaccagaggtccctcaaaacccagatactgcaccacatactccaaaaacccctcggatccctggtcaatcaaaagacgtgacacctgctcctcaaaacccttctaatagaggtctaaacaaaccacaaacacaaggtggtaatcagctcgcaaaaacaccggcagctcacgacacacacagacaattgccagcaacaggcgaaacaaccaatccattctttacagcagctgctgtagctatcatgacgacagctggagttgtagctgttgcaaaacgtcaagaaaacaac

SEQ ID NO: 723 - DNA, 960 bp, Streptococcus pyogenes
atgaacaatagacataaacggcgccaaaaaagaaaagccttcactctcattaaccttatactattatttgcctgcattcttggtttgaccctcattttctatttatatcaagggtctaacaaattcggcttgtcagatgtctctcgatttgtacctaaaataagtctttttcatcacaaaaagacggcaaaaaaagaaacgacaaaacttaagaagactcatttcgattcctcaaaatctcaaaaaaaggcccattctaaattgacttggaccaagcaagaaacacctgtcaagatcccaattttaatgtatcatgctattcatgtaatgtcccctgaagagacggctaatgctaatttgattgtcaacccagatctctttgatcaacaacttcaaaaaatgaaagacgagggctactattttttgagtcctgaagaggtctaccgcgctctttcaaataatgaattgcctgctaaaaaagttgtatggctaacatttgatgacagtatgattgatttctacaatgttgcttacccaatcttaaaaaaatatgatgctaaagccaccaataatgttattacaggactaaccgaaatgggaagcgctgccaatctgactcttaagcagatgaaagaaatgaaacaagtcggtatgtctttccaagatcatacagtgaatcatcctgatctagagcaggctagtcctgatgttcaaacaactgaaatgaaagattcaaaggactatcttgataagcaattaaaccaaaacactattgccattgcttatccatctggtagatataatgacactaccttacaaattgcagctagacttaactataaattaggtgttaccactaacgaaggaatagctagcgcggctaatggacttctttctcttaaccggattcgtatcctcccaaacatgagtcctgaaaatcttttacaaacaatggaacca

SEQ ID NO: 724 - DNA, 1050 bp, Streptococcus pyogenes
atgaacaagaaatttattggtcttggtttagcgtcagtggctgtgctgagtttagctgcttgtggtaatcgtggtgcttctaaaggtggggcatcaggaaaaactgatttaaaagttgcaatggttaccgatactggtggtgtagatgacaaatcattcaaccaatcagcatgggaaggcctgcaatcttggggtaaagaaatgggccttcaaaaaggaacaggtttcgattattttcaatctacaagtgaatctgagtatgcaactaatctcgatacagcagtttcaggagggtatcaactgatttatggtatcggctttgcattgaaagatgctattgctaaagcagctggagataatgaaggagttaagtttgttattatcgatgatattatcgaaggaaaagataatgtagccagtgttacctttgccgaccatgaagctgcttatcttgcaggaattgcagctgcaaaaacaacaaaaacaaaaacagttggtttcgtgggcggtatggaaggaactgtcataactcgatttgaaaaaggttttgaagcaggagttaagtctgttgacgatacaatccaagttaaagttgattatgctggatcatttggtgacgctgcaaaaggaaaaacaatcgcagcagctcagtatgcagcaggtgctgatgttatttaccaggcagcaggaggcactggagcaggtgtatttaatgaagcaaaagctattaatgaaaaacgtagtgaagctgataaagtttgggttattggtgttgaccgtgatcaaaaagacgaaggaaaatacacttctaaagatggcaaagaagcaaactttgtacttgcatcatcaatcaaagaagtcggtaaagctgttcagttaatcaacaagcaagtagcagataaaaaattccctggaggaaaaacaactgtctatggtctaaaagatggcggtgttgaaatcgcaactacaaatgtttcaaaagaagctgttaaagctattaaagaagcgaaagcaaaaattaaatctggtgacattaaagttcctgaaaaa

SEQ ID NO: 725 - DNA, 864 bp, Streptococcus pyogenes
atgaaaatgaaaaaaaaattctttttgttaagtcttttggccctatcaactttctttttatccgcatgttctagctggattgataaaggtgagtcaataaccgctgtaggatcaacagcactacaacccttagtagaagcagtagctgatgaatttggaagcagtaatctaggcaagactgtcaatgttcaaggtggtggttcaggtacagggttgtctcaagttcaatcaggagctgtccaaattggaaatagtgatgtctttgcggaagaaaaagatggtattgatgcttctaaattagttgatcatcaagtagctgttgcaggacttgcagttattgccaatcctaaagtcaaggtttccaatctcagtagtcagcagttgcaaaagattttttcaggagaatataccaattggaaacaagttggaggagaagatcttgcgatttcagtgatcaaccgagcagcaagttctggctcacgagcaacctttgacagtgttatcatgaaaggggtcaacgctaaacaaagtcaagagcaagactccaatgggatggttaaatcgattgtttcacaaacaccaggtgccatttcttacctttcctttgcctacgttgattcatctgttaaatctttgcaattaaatgggtttaaggcaaatgctaagaacgtggctacaaatgattggccaatctggtcctacgaacacatgtataccaaagataaaccaacagggttgaccaaggaatttcttgattatatgttttcagatgaagtacaacagaacattgttacacatatgggatatatttcgataaatgatatggaagtggtcaaatctcatgatggaaaagtaacaaaaagg

SEQ ID NO: 726 - DNA, 771 bp, Streptococcus pyogenes
atgaaacccaaacaccttctctgtctttcaacagttgttgctggattagctttattttcaactatgacgcactcagttttagctgatgatgcttcaaatcccgatgctattttaatgaataacaaccaagcaaattttcaaagagatgctctagtgcaaaagcttgatgagggacatcaacaattagaagctattaaacatgaagctaaaggtactgatattgagactactgttaacaaagctatcgatgctgttgatcacatgaagagttctatacgcttcaatactgaaacgatctatgattttagttcaattggggcaagagtagaagcattatcagatgctatcaaagcaatcgtattttccacaacccaattaactcataaagtagaaaaagcgcatactgatatggggtttgctattactaaattagtcattcgtattatagatccatttgcatctgttgacgctatcaaagctcaagtacaagaaattaaagcacttgaggaaaaagttatcaattatcctgatttacagccaacagaccgtgctactatctatactaaagctaaactaaataaagctatttggaacactcgtttagaaagagataaaaaggttttgggaatcaaaccatttgacgtttacaatagacttaacaaagctatcacacatgcggttggtgtccaactaaatccgacaaccactgttcaacaagttgacgatgaagttattgctgtgcaagatgctttggaaacagctcttaagtca

SEQ ID NO: 727 - DNA, 834 bp, Streptococcus pyogenes
atgattataaaaaaaagaaccgtagcaattttagccatagctagtagctttttcttggtagcttgtcaagctactaaaagtcttaaatcaggagatgcttggggagtttaccaaaagcaaaaaagtattacagttggttttgacaatacgtttgttcctatgggctataaggatgaaagcggcagatgcaaaggttttgatattgatttggctaaagaagtttttcaccaatatggactcaaggttaactttcaagctattaattgggacatgaaagaagcagaactaaacaatggtaaaattgatgtaatctggaatggttattcaataactaaggagcgtcaggataaggttgcctttactgattcttacatgagaaatgaacaaattattgttgtcaaaaaaagatctgatattaaaacaatatcagatatgaaacataaagtgttaggagcacaatcagcttcatcaggttatgactccttgttaagaactcctaaactgctgaaagattttattaaaaataaagacgctaatcaatatgaaacctttacacaagcttttattgatttaaaatcagatcgtatcgatggaatattgattgacaaagtatatgccaattactatttagcaaaagaagggcaattagagaattatcggatgatcccaacgacctttgaaaatgaagcattttcggttggacttagaaaagaagacaaaacgttgcaagcaaaaattaatcgtgctttcagggtgctttatcaaaatggcaaatttcaagctatttctgagaaatggtttggagatgatgttgccactgccaatattaaatct

SEQ ID NO: 728 - DNA, 618 bp, Streptococcus pyogenes
atgacaaaaaaacacttactaacacttcttctcatctctttttttactagctttttggtagcttgttcaacaacgaaagataaagagcctcaaccgtctgattcagaaatcattactccccgactacaccaagccgctcatcaagataaacgcgctaactttgaaaaaattaaacttgcgactgttgattcctcatttacaggagggacaagccttgaagaacttatttcactctttggagagcctagccaacatgatccaaaaacagcaggcgaagtaacaatcgacgcttatacttggcagtttgatcaagttactctcactgttaatctttatcaaaatagtagtattgttaaaaccatctctaattttacctttgcaagagagttaggcttatcgcaaaaggaataccaacaattacaaaaaggaatgtcttatgaagacgttaaaaagatcttaacagaacctgataattatagccaagcgtcatctagtgatcatcaaactttgcaagcgatttgggttagtggcttaaagacagatacaagcggagctaatatttctctcgtttttgaaaataatcagttaacagaaatgtctcaggtaggacttgaagaa

SEQ ID NO: 729 - DNA, 1245 bp, Streptococcus pyogenes
atgaaatcatggcaaaaagttatcgtcggcggagcaagtttgacacttgcaagtaccttgttagtgggatgtggatcaggttcaaaagataaaaaggaagctggcgctgactcaaagactattaaactttgggtaccgactggctctaaaaaatcatatgcagataccattgcaaaatttgaaaaagattctggttacaccgttaaagtggttgaatcagaagatccaaaagcacaagaaaaaatcaaaaaagatgcctcaactgctgccgatgtcttttcacttcctcatgatcaacttggtcaacttgtagaatctggtactattcaagaagttccagaaaagtacaataaagaaattgctgctacttctactgatcaggcgctcgtcggtgcacagtacaaagggaaaacatatgctttcccatttggtattgaatcacaagttcttttctacaataaatcaaaattagctgctgaagacgttacttcatatgatacaattactacaaaagcaacttttggtggtacctttaaacaagctaacacttacgctactggtccattattcatgtcagttggtaacactttatttggggaaaacggtgaagatgtaaaaggtactaactggggcaatgaaaaaggcgctgctgttcttaaatggatcgcagaccaagcttcaaataaaggttttgttagcttagatgctaacaacgttatgtctaaatttggtgacggttcagtagcttcctttgaatcaggaccgtgggactatgaagctgctcaaaaagctatcggtaaagaaaaccttggtgttgctatttatccaaaagtaactattggaggcgaaacggttcaacaaaaagcattcttgggtgtaaaactttacgcagtcaaccaagcaccagctaaaggtgatacaaaacgtatcgcagctagctacaaattggcatcctacttgactaatgctgaaagccaagaaaaccaattcaaaactcgtaacattgtcccagccaacaaagaagttcaatcttcagaagctgttcaatcaaacgaacttgctaaaaccgttatcactatgggttcttcttcagactacactgtcgtaatgccaaaacttagccaaatgggcacattctggactgaaagtgctgctattcttagtgatgccttcaacggtaaaatcaaagaaaacgactaccttactaagttgcaacaattcgacaaagatatcgctgcaacaaaa

SEQ ID NO: 730 - DNA, 2133 bp, Streptococcus pyogenes
atgagagaattacatatcaaaacttataagttattaacgaaaagtgctgttttacttggcttaatttcatttccactaactgtttctgctgccgataatgcttctgtcaccaacaaagcagatttttcaacagatacgatttatcagattgtaacagatcgttttaacgatggtaatacctctaataatggtaagactgatgtttttgataaaaatgaccttaaaaaataccatggaggtgattggcaaggaatcatcgccaagattaaggatggttacctgacagatatggggatttctgccatttggatttcttctcctgttgaaaatatcgacagtattgatccttctaatggaagtgctgcatatcatgggtattgggctaaggacttctttaaaacaaaccagcattttggcactgaagcagactttcaacaactagtcaaagtagctcatcaacaccatattaaggtagttattgattttgctcctaatcatacgtctacagccgaaaaagaaggcacaactttcaaagaagatggcgctttatataaaaacggtaaattagttggtaaattttcagatgataaagacaagatttttaatcatgaatcttggaccgattttagtacttatgaaaattctatttatcattcaatgtacggactagctgatttaaataacattaatccgaaagttgaccagtacatgaaagaagctattgataaatggttagacctgggtgttgatggtatccgagttgacgctgttaaacatatgtcacaaggttggcaaaaaaattggttgagtcatatctatgaaaaacataatgtctttgttttcggggaatggttctcgggacataccgacgatgattatgatatgacgacatttgctaacaatagtgggatggggcttttagattttagatttgccaatgctattagacagttgtatacaggtttttcaacgtttaccatgcgagatttttacaaggttcttgaaaatagagatcaggtgactaatgaagtgacagaccaggtgacctttattgataatcatgatatggaacgcttcgcaacaaaagtggctaataatcaaactgctgttaatcaagcctatgctttgcttttaacatctagaggtgtgcctaatatttattatggtacagagcagtatgcaacaggtgataaagatcctaataatcgtggtgatatgccaagttttaataaagagtcacaagcctataaagtgattagtaagctagctcctttaagaaaacaaaatcaagctttagcttatggaacaactgaacaacgttggattagtgatcatgttttggtatttgagcgtaaatttggtaatcatgtcgcactagtggctattaatagagatcaaacgaatggttatacaattactaatgctaaaacagccttgccccaaaatagctacaaggacaaattagaaggtcttcttggcggtcaagaattaatagttggagcagatggcactattagtagctttgaacttggagcggggcaagtcgctgtatggacttatgaaggagaggacaagacaccacaacttggagatgtcgatgcttcagtgggtattgctggaaataagattactatttcaggtcaaggttttggtaattctaaaggtcaagtgacttttggagaaatctctgctgagatcctttcttggtcagatacccttatcaccttaaaagtaccgacggttccagcaaattattataacatttcagtgacaactgccgataagcaaaccagcaatagttaccaagcctttgaagtattgactgataaacaaattcctgttcgtttactcatcaatgattttaagacagtaccaggggaacaactatatctcatgggtgatgtttttgagatgggggcaaatgacgctaagaatgctgttggtcctctatttaataacactcagaccattgccaagtacccaaactggttctttgatactcatctaccaatcaataaagaaatagcagtcaaacttgttaaaaaagatagtattgggaatgttttatggacaagtcctgagacttatagtataaagacaggtcatgaagcacaaaccattactataaaaaaa

SEQ ID NO: 731 - DNA, 2376 bp, Streptococcus pyogenes
atgaaaacgaaaaaagttattattttagttggtctattgttatcatctcagttgactttgatagcttgtcaatcacgaggtaatggtacatatcccattaaaacgaaacaatcacgtaagggaatgacgtcaaacaaaattaaaccgattaaaaaaagcaaaaagacaaacaagactcacaaaggtgtggcgggtgtcgattttcctacagatgatgggtttattttaaccaaagactcaaaaatcttatcaaaaacagatcagggaatcgttgttgaccatgatggtcattcgcattttattttttatgccgatttaaagggaagtccatttgaataccttattccaaaaggagcaagtttagctaagccagctgttgctcagcgagcagctagtcaagggacttctaaagtagcagatcctcatcaccattatgaatttaacccagcggatattgtggctgaagatgctttaggctacacggttcgccacgatgatcacttccattatattttgaagtcaagcttatcaggtcagacacaggcacaagctaaacaggttgctactcgcttgccacaaaccagtagccttgtttcaacagctacagctaatggtattccaggcttgcatttcccaacctcagatggttttcaatttaacggtcaaggtattgttggggtaacaaaagacagtattttagtggaccacgatggtcacttacatcctatttcttttgcggaccttcgtcagggtggctgggcacatgtggcagatcaatacgatcccgctaaaaaagcagaaaagccagcagaaacccatcagacaccagagctatctgaacgtgaaaaggaataccaagaaaaattagcttatttggcagaaaaattggggattgatccatcaactattaaacgtgtggaaacacaagacggtaaacttggtttggaataccctcaccatgaccacgcacacgtattgatgttatctgatattgaaatcggaaaagacattccagatccacatgctattgagcatgcccgtgaattggaaaaacataaggttggaatggataccttgcgtgccttagggtttgatgaagaagtgattttggatatcgttcgcactcacgatgctccaaccccattcccatcaaatgaaaaagatccgaatatgatgaaagaatggttagcaacggttatcaaacttgacttgggcagccgtaaagatcctttgcaacgtaaaggactttcactgttacccaacttagaaactttaggaattggctttacaccaatcaaagatatctcacctgttttgcaatttaaaaaattgaaacagttgttaatgacaaaaacaggggtgactgattatagatttttggataatatgccacagttagaaggcattgatatttcacaaaacaatctcaaagatattagtttcttgagcaaatataaaaacttaactctagtagcggctgctgataatggtattgaagatattaggccgcttggtcaattaccaaatctcaaattcctcgtattgagtaacaataagatttctgatttaagcccactggcatcgttacatcaattgcaagaattgcacattgataataatcagattacagatttaagccctgtttctcataaagaatcattgacggttgttgatttatcaagaaatgctgatgttgacttagcaacacttcaagcacccaaattagaaacgttaatggtcaatgataccaaggtttctcatttggatttcttgaaaaataatcctaatctatctagcctatctattaaccgtgcgcaattgcaatctcttgaaggtattgaagcaagtagcgtcattgtcagagtagaagcagaaggtaaccaaattaaatcgcttgtgcttaaagacaagcaagggtcacttactttcttggatgtgacaggcaaccagttgacttctctagaaggtgttaataattttacagcacttgacattttaagcgtgtctaaaaaccaattaacaaatgtcaacctatctaaacccaataagacagttactaacattgatattagtcataacaatatctcattagcagaccttaaattgaacgagcaacatattccagaagccattgcgaaaaacttcccagcggtttacgaaggttctatggtaggtaatggaacagctgaagaaaaagcagctatggctactaaggcgaaagaaagtgctcaagaagcatcggaatcacatgactacaaccataatcatacctatgaagatgaagaaggtcatgctcacgagcacagagacaaagatgatcacgaccatgaacatgaggatgaaaatgaagctaaagatgagcaaaaccatgctgac

SEQ ID NO: 732 - DNA, 1053 bp, Streptococcus pyogenes
atgaaaaactcaaataaactcattgctagtgttgtgacattggcctcagtgatggctttagcagcttgtcaatcaactaatgacaatactaaggttatttcgatgaaaggtgatacaattagcgttagtgatttttacaatgaaacaaaaaacacagaagtatcgcaaaaagcgatgctaaatctggtaattagtcgtgtttttgaagctcaatatggtgataaggtttcaaaaaaagaagttgaaaaggcgtatcataaaacagctgaacagtatggcgcttcattctctgctgctttggcacaatcaagcttgacacctgagacttttaagcgtcagatccgctcttcaaaattagtagaatatgcggttaaagaagcagctaaaaaagaattgacaacacaagaatataagaaagcatatgaatcttatactccaacaatggcagtcgaaatgattactttagataatgaagagacagctaaatcagtcttagaggaactaaaagccgaaggcgcagactttacagctattgctaaagaaaaaacaacaacacctgagaaaaaagtgacctataaatttgattcaggtgcgacaaatgtaccgactgatgtcgtaaaagcggcttcaagtttgaatgagggtggcatatcagacgttatctcggttttagatccaacttcttatcaaaagaagttttacattgttaaggtgactaaaaaagcagaaaaaaaatcagattggcaagaatataagaaacgtttgaaagctatcattatagctgaaaaatcaaaagatatgaatttccaaaacaaggttattgcaaatgcattggataaagctaatgtaaaaattaaagacaaagcttttgctaatattttggcgcaatatgcaaatcttggtcaaaaaactaaagctgcaagtgaaagttcaacaaccagcgaatcatcaaaagctgcagaagagaacccatcagaatcagagcaaacacagacatcatcagctgaagaaccaactgagactgaggctcagacgcaagagccagctgcacaa

SEQ ID NO: 733 - DNA, 585 bp, Streptococcus pyogenes
atgaaaaaaaaatcaaaccttaattggtggaagtggagcttcttatgtctgcttgcttttaataccgcctttttgatggttattgcaagtcgtctcattcaagtaagagaacctgagtcagaactgattgctaaaaaaccagttaaaaatatcaaaattggtacatttgttacaaccagagaacagcttaacgaaactgtagcaagttatcttaaagattatcagactgaaaaaatgtcttataaattttatgcgacatcttcttctattttgtttgaaggaacttatcaattattagggtatgaagtccctttatatatctattttcaacctcatcgtctagaaaatggagctgtccaactacaggtgatctctttttcagtgggaactctgccactcccagaaaaagatgttttgcagtatttgaaatcaagctacaaattgccaagctttgttaaagtgatgccaaatcaatcagctatcgttgttaatttacaagatatccaaaatgatgctaaggtttatttaaaagccaagaaaattgatttatttaatgatgaaatcagttttaacatctataagaaa

SEQ ID NO: 734 - DNA, 621 bp, Streptococcus pyogenes
atgaaaaaaggactattagtaacaactggtttggcttgtctcgggctactaactgcttgctcaacccaagacaatatggctaaaaaggaaataactcaggacaagatgagcatggcagctaaaaagaaagataagatgtcaacatcaaaggacaagtccatgatggcagataaatcatctgataagaaaatgaccaatgatggtcctatggcgcctgatttcgaactcaaaggcatcgatggtaagacctatcgcttatcagagttcaaaggtaaaaaagtttatttgaaattttgggcctcttggtgttcaatctgtctatcaaccttggcagataccgaagacctggctaaaatgtcagataaagactatgtggtcctaacagttgtctcgccaggtcatcaaggggaaaaatcagaagcagactttaaaaaatggttccaaggaacagactataaggacttaccagtcttgttagatccggatggcaagctattggaagcttacggtgtcagatcttacccaacagaagttttcattggaagtgatggtgttcttgctaaaaaacacattggttatgccaaaaaatcagacatcaaaaagacccttaaaggtatacat

SEQ ID NO: 735 - DNA, 1140 bp, Streptococcus pyogenes
atgaaaaaatggcaaaaaatcgtgtgtgtgactggaactgtgcttgcaacgtctaatttagcagcctgcgaaagcaagtcagcatcaaaagatagtgatgtcaaattattgatgtaccaagttggtgacaaacctgataacttcgatgaattgatgacaattgctaacaagcgcatcaaagaaaaaacaggtgcaacggttgaccttcaatacatcggttggggggactgggatgataaaatgagtaccatcattgcctctggtgaaaactacgacattgcttttgccaataattatgtggtcaatgcacaaaaaggtgcttttgctgatttgacaacgttaatgccaaaatacgctaagaaaacgtataaaaacttagacccagcctatattaaaggaaatactattgacggtaaactctatgccttcccagtagatgccaacgtttatgcccaacagatgctttctttcaataaagaactagtggacaaatatggccttgacatttcaaacattaagtcctatgcagatgctgaaaatgtcttgaaacaattccacgaaaaagaaccaaatacagcagcttttgctattggtcaagtctttagtatgtcaggtgactatgactacccattaaccaaaacccaaccctttgctgtgaaaattgatgaaggcaagccaaccatcattaatcagtatgaagatgagtcctttaaaaacaatctccgcttgatgcacaaatggtataaagaaggtttgattccaacagatgcagcgaccaatacagaaggttatccccttgaaggaaacacttggtttatgcgtgaagaaacccaaggtcctatggactatggcgatactatcttgaccaatgctgcaggaaaagacatcgtgtctcgtccattgactaaaccgctaaaaaccacatcacaagcacaaatggcaaactttgtggtatcaagcgtatctaaaaacaaagaaaaagcagttgaagtcctttctcttcttaatagcgatcccgaattgttaaatgggcttgtttatggtgtcgaaggcaaagcttgggaaaaaattggcgacaagaaaatcaaactgctcgatggctatcaacctaaaaatgcacatgggtgcttggaatactgg

SEQ ID NO: 736 - DNA, 1605 bp, Streptococcus pyogenes
atggttaatattattttattaattgtttctgccctcattggtttaatattaggttatgcacttatttcgattagactcaagtctgcgaaggaagctgcagagttgactcttttaaacgctgaacaagaagctgttgatattcgtggcaaagcagaagtagatgctgaacacatcaaaaaaacagctaaacgtgaaagtaaagcaaatcgtaaagaattacttttagaagcaaaagaagaggcaagaaaatatcgtgaagagattgaacaagaatttaagtctgaaagacaagagcttaaacaactcgagacacgcttagcggagcgctccttaactcttgaccgtaaagatgaaaacctatcaagtaaagaaaaggtactagatagtaaagaacaaagtctgaccgataaatctaaacacattgatgagcggcaacttcaagtggaaaaacttgaagaggagaaaaaagcagaactggaaaaagttgctgcgatgacgattgcagaagcgcgtgaagtgattttaatggagacggaaaacaaactgacccatgaaattgcgacgcgcattcgagatgccgaacgtgacatcaaggaccgaacagttaaaacagccaaggacttgttagcgcaagccatgcaacgccttgctggtgagtatgtgactgaacaaactattaccagtgtccatctcccagacgacaacatgaagggccgaattattggacgtgaaggccgtaatattcgtactttagagagcttgactggcattgacgttattattgacgatactcctgaagttgttatcttatcaggatttgatcctattcgacgtgaaattgctcgtatgaccttggaatctctgattgctgatggtcgcatccatccagctcgtatcgaggaattggttgagaaaaatcgtcttgaaatggataatcgtattcgtgagtacggtgaagctgcagcctatgagattggtgcaccaaaccttcatcctgatttgattaaaatcatgggacgcctgcaattccgtacctcgtttggtcaaaatgtcctacgtcactctgttgaggttggtaagttagctggtattttagctggtgagttaggtgaaaatgttgctcttgcccgccgtgctggtttcttgcatgatatgggtaaagctattgaccgtgaggttgaaggcagtcacgttgagattggaatggaatttgcacgtaaatacaaagaacatccagttgttgtcaacactattgctagccaccacggagatgtggagccagattctgtgatcgctgtgctagtagctgcagcagacgctctcagttcggctcgtccaggcgctcgtaatgagtcaatggagaattacatcaagcgtcttcgtgatttagaagaaatcgcgacaagttttgatggggtacaaaatagttttgctctacaagctggacgtgagattcgtattatggttcaacctgaaaaaatttcagatgatcaggttgtcattttgtcgcataaagtaagagaaaaaattgaaaacaatctagattacccaggaaatattaaagtaactgttattcgtgagatgagagcggttgattatgccaag

SEQ ID NO: 737 - DNA, 1272 bp, Streptococcus pyogenes
atgaaaattggaaaaaaaatagttttaatgttcacagctattgtgttaacaactgtcttggcattaggtgtctatctaactagtgcttataccttctcaacaggagaattatcaaagacctttaaagatttttcgacatcttcaaacaaaagtgatgccattaaacaaacaagagctttttctatcttgttgatgggtgttgatacaggctcttcagagcgtgcctccaagtgggaaggaaacagtgattcgatgattttggttacggttaatccaaagaccaagaaaacaactatgactagtttagaacgagataccttaaccacgttatctggacccaaaaataatgaaatgaatggtgttgaagctaagcttaacgctgcttatgcagcaggtggcgctcagatggctattatgaccgtgcaagatcttttgaatatcaccattgataactatgttcaaattaatatgcaaggccttattgatcttgtgaatgcagttggagggattacagttacaaatgagtttgattttcctatctcgattgctgaaaacgaacctgaatatcaagctactgttgcgcctggaacacacaaaattaacggtgaacaagctttggtttatgctcgtatgcgttatgatgatcctgagggagattatggtcgacaaaagcgtcaacgtgaagtcattcaaaaggtattgaaaaaaatccttgctcttgatagcattagctcttatcggaagattttatctgctgtaagtagtaatatgcaaacgaatatcgaaatctcttctcgcactatccctagtctattaggttatcgtgacgcacttagaactattaagacttatcaactaaaaggagaagatgccactttatcagatggtggatcataccaaattgttacctctaatcatttgttagaaatccaaaatcgtatccgaacagaattaggacttcataaggttaatcaattaaaaacaaatgctactgtttatgaaaatttgtatgggtcaactaagtctcagacagtaaacaacaactatgactcttcaggccaggctccatcttattctgatagtcatagctcttacgctaattattcaagtggagtagataccggccagagtgctagtacagaccaggactctactgcttcaagccataggccagctacgccgtcttcttcatcagatgctttagcagctgatgagtctagctcatcagggtctggatcattagttcctcctgctaatatcaaccctcagacc

SEQ ID NO: 738 - DNA, 882 bp, Streptococcus pyogenes
atgataaaacgatgtaaaggaattggtctagccttaatggccttctttttggtagcttgtgtgaatcagcaccctaaaacggctaaagagactgaacagcagagaattgtagccacttcggttgctgtggttgatatctgtgaccgtttaaatttagacctcgttggggtttgtgatagtaaattatatacccttcctaaacgctatgatgctgttaagcgtgtgggtttacccatgaatcctgatatagagttgattgcttctttgaaaccaacttggattttgagtcccaattctttacaagaagatttggaacccaagtatcaaaaattggatactgagtatggttttttgaacttacgaagtgttgagggcatgtaccagtccattgatgatttagggaaccttttccaacgtcaacaagaagcaaaagaattgcgccagcaataccaggactattatcgtgctttccaagctaaacgtaaggggaagaaaaagcctaaagtgcttattcttatgggcttgccaggtagttatttggtggcgacgaaccaatcttatgtagggaatcttttggacttggcaggtggtgagaatgtttatcagtcagatgagaaagaatttctatcagctaatcctgaagacatgctggctaaggagcctgacttgattttacgaacagctcatgccattccagacaaggtaaaagtgatgtttgacaaagaatttgctgaaaatgatatttggaaacattttacggcagtcaaggaagggaaagtctatgatttggacaataccctgtttggcatgagtgctaaattgaactacccagaagccttggacaccttaacacagctttttgaccacgtgggagatcatccg

SEQ ID NO: 739 - DNA, 1509 bp, Streptococcus pyogenes
atgaataaaaacaaactattaagagttgccatgctactaagtctcttagccccgacagcagaaagcatgacagtgctggctcaagatgtaatgcttgagacgcataaagcaactacaaatgaaaccagtgattcttcttcaaaagaggaaaataataaaaatgcagcacctacaacatcagataaaactgaccaaggtccccttgatgcttctgcagaaacaaactctaatagtcttgttaacgcggatgataaaaaaagaagcgattctagtcagtctgctataggctcttcggacaacaaggcagaagcagaaaaccaggtagatgataaatcaactgatcattcgaaatcaactgatcattcgaaaccaactgaccagcccaaaccatcaccatctaaagttgatacggcacctgcttcttcattgtcgaaacaactgccagaggcaagaactcctattcagtcgttgtccccttacgtatcagatttagatttgagtgagatagatatcccttctgtcaacacatacgcggcatatgtagagcattggagtggtaaaaatgcctatacccaccatcttttatctcgccgttatggtattaaagctgaccagattgatagttacttaaaatcaacaggcattgcctatgacagcacacgtattaatggtgagaagctattgcaatgggaaaagaaaagtgggctggatgttcgagctatcgtagctattgcgatgtctgagagttctttaggaactcaagggattgcaactttgcttggagctaatatgtttggctatgcagcttttgatctagatccgactcaagcaagtaagtttaatgatgatagtgctattgtcaaaatgacacaagacaccattattaaaaacaaaaatagcaattttgcacttcaagatttaaaagcggctaagttttcacgaggtcaattaaactttgcaagtgacgggggtgtttattttactgatactactggtagtggtaaacgtcgcgcacaaattatggaagacctggataagtggattgatgaccatggtggcacaccagccattccagccgaattgaaagtgcagtcatcagctagttttgcatctgtgccagcaggttataagctctctaagagttatgatgtcttgggttatcaagcttcgagttatgcttggggacaatgcacttggtatgtgtataatcgcgccaaagaattgggttaccaatttgatccttttatgggaaatggtggagattggaagtataaagtagggtatgccctttcaaagactccaaaagtaggttatgctatttcatttgcaccagggcaagcgggcgctgatggcacttatggccacgtatcaattgtagaagatgttagaaaagatgggtctattcttatttcagagtctaactgtatcggcttaggtaagatttcttatcgtacctttacagctcagcaggctgaacagctaacatatgttattggcaagagtaaaaac

SEQ ID NO: 740 - DNA, 852 bp, Streptococcus pyogenes
atgaaatccaaaaaagttgttagtgttatatcacttaccttatccctttttttggtgacaggttgtgctaaagttgataacaacaaatcagttaatcttaagcctgctactaaacaaacctataatagctatagtgatgaccaattaagatcgcgtgaaaataccatgtctgttttatggtaccagcgagctgcggaaactcaagcgctttatttacaggggtatcagttagcaacggatcgcttaaaagaacaactcaataaaccaacggataaaccttattcaattgtattagatattgacgaaacagttcttgataatagcccttatcaagctaaaaatgttttggaaggaacaggatttacacctgaaagctgggattattgggtacaaaagaaagaagcaaaaccggttgctggtgctaaagactttttgcaatttgcagaccaaaatggtgttcaaatttactacatttcagacagatcaactactcaagtagatgctacaatggaaaatctccaaaaagaaggtattccagtacaaggtcgtgatcatcttctattcttagaaaaaggcgtaaaatcaaaggagagtcgtcgtcaaaaggtcaaagaaacaactaatgtaacgatgctatttggtgataatcttctagattttgctgatttttcaaaaaaatctcaagaagatagaacagctttattatcagatttacaagaagagtttggaagacgctttatcattttccctaatcctatgtatggttcatgggaaggtgccatttataaaggtgaaaagctggatgtgcttaagcaactagaggaacgccgtaaaagtttaaaaagctttaaa

SEQ ID NO: 741 - DNA, 1320 bp, Streptococcus pyogenes
atgaaaaattacttatctattggagtgattgcactgctgtttgcattaacatttggaacagtcaagtcggtccaagctattgctgggtatggatggctaccagaccgtccacctatcaataacagccagttagttgttagtatggccggtatcgttgaaggtaccgataaaaaagtttttataaatttttttgaaatcgatctaacatcacaacctgctcacggaggaaagacagagcagggcttaagtccaaaatcaaaaccatttgctacagataatggcgcaatgccacataaacttgaaaaagctgacttattaaaagctattcaaaaacagctgatcgctaacgttcacagtaacgacggctactttgaggtcattgattttgcaagcgatgcaaccattactgatcgaaacggcaaggtctactttgctgacaaagatggttcggtaaccttgccgacccaacctgtccaagaatttttgttaaagggacatgtgcgcgttagaccatataaagaaaaaccagtacaaaatcaagcaaaatctgttgatgtagaatatactgtacagtttactcctttaaaccctgatgacgatttcagaccagggctcaaagatactaagctattgaaaacactagctatcggtgacaccatcacatctcaagaattactagctcaagcacaaagcattttaaacaaaacccacccaggctatacgatttatgaacgtgactcctcaatcgtcactcatgacaatgacattttccgtacgattttaccaatggatcaagagtttacttaccatgtcaaaaatcgggaacaagcttatgagatcaatcctaaaacaggtattaaagaaaaaacgaacaacactgatctggtctctgagaaatattacgtccttaaacaaggggaaaagccgtatgatccctttgatcgcagtcacttgaaactgttcaccatcaaatacgttgatgtcaacaccaacgaattgctaaaaagcgagcagctcttaacagctagcgaacgtaacttagacttcagagatttatacgatcctcgtgataaggctaaactactctacaacaatctcgatgcttttgatatcatggactataccttaactggaaaagtagaggataatcacgataagaataatcgtgtcgttacagtttatatgggcaagcgccctaaaggggcaaagggtagctatcatttagcttatgataaagatctctataccgaagaagaacgaaaagcttacagctacctgcgtgatacagggacacctatacctgataaccctaaagacaaa

SEQ ID NO: 742 - DNA, 1632 bp, Streptococcus pyogenes
ttgattgtgtcaaaatacctaaaatacttctctattatcacgttatttttgactgggcttattttagttgcatgtcaacaacaaaagcctcaaacaaaagaacgtcagcgcaaacaacgtccaaaagacgaacttgtcgtttctatgggggcaaagctccctcatgaattcgatccaaaggaccgttatggagtccacaatgaagggaatatcactcatagcactctattgaaacgttctcctgaactagatataaaaggagagcttgctaaaacataccatctctctgaagatgggctgacttggtcgtttgacttgcatgatgattttaaattctcaaatggtgagcctgttactgctgatgatgttaagtttacttatgatatgttgaaagcagatggaaaggcttgggatctaaccttcattaagaacgttgaagtagttgggaaaaatcaggtcaatatccatttgactgaggcgcattcgacatttacagcacagttgactgaaatcccaatcgtccctaaaaaacattacaatgataagtataagagcaatcctatcggttcaggaccttacatggtaaaagaatataaggctggagaacaagctatttttgttcgtaacccttattggcatgggaaaaaaccatactttaaaaaatggacttgggtcttacttgatgaaaacacagcactagcagctttagaatctggtgatgttgatatgatctacgcaacgccagaacttgctgataaaaaagtcaaaggcacccgcctccttgatattccatcaaatgatgtgcgcggcttatcattaccttatgtgaaaaagggcgtcatcactgattctcctgatggttatcctgtaggaaatgatgtcactagtgatccagcaatccgaaaagccttgactattggtttaaataggcaaaaagttctcgatacggttttaaatggttatggtaaaccagcttattcaattattgataaaacaccattttggaatccaaaaacagccattaaagataataaagtagctaaagctaagcaattattgacaaaagcgggatggaaagaacaagcagacggtagccgtaaaaaaggtgaccttgatgcagcgtttgatctgtactaccctactaatgatcaattgcgagcgaacttagccgttgaagtagcagagcaagccaaggccctagggattactattaaactcaaagctagtaactgggatgaaatggcaacgaagtcacatgactcagccttactttatgccggaggacgtcatcacgcgcagcaattttatgaatcgcatcatccaagcctagcagggaaaggttggaccaatattacgttttataacaatcctaccgtgactaagtaccttgacaaagcaatgacatcttctgaccttgataaagctaacgaatattggaagttagcgcagtgggatggcaaaacaggtgcttctactcttggagatttgccaaatgtatggttggtgagccttaaccatacttatattggtgataaacgtatcaatgtaggtaaacaaggcgtccacagtcatggtcatgattggtcattattgactaacattgccgagtggacttgggatgaatcaactaag

SEQ ID NO: 743 - DNA, 918 bp, Streptococcus pyogenes
atgaaaaaaggtttttttctcatggctatggtcgtgagtttagtaatgatagcagggtgtgataagtcagcaaaccccaaacagcctacgcaaggcatgtcagttgtaaccagcttttacccaatgtatgcgatgacaaaagaagtatctggagacctcaatgatgtgaggatgatccaatcaggtgcaggcattcattcctttgaaccgtctgtaaatgatgtggcagctatttatgacgcggatttgtttgtttaccattcacataccttagaagcttgggcaagggatctagaccctaatttaaaaaaatcaaaggttgatgtgtttgaagcgtcaaaacctttgacactagatagagtcaaagggctagaagatatggaagtcacacaaggcattgatcctgcgacactttatgacccacatacctggacagatcccgttttagctggtgaggaagctgttaatatcgctaaagagctaggacgtttggatcctaaacacaaagacagttacactaaaaatgctaaggctttcaaaaaagaagcagagcaactaactgaagaatacactcaaaaatttaaaaaggtgcgctcaaaaacattcgtgacgcagcacacggcattttcttatctggctaaacgattcggcttgaaacaacttggtatctcgggcatttccccagagcaagagccctctcctcgccaattgaaagaaattcaagactttgttaaagaatacaacgtcaagactatttttgcagaagacaatgtcaatcccaaaattgctcatgctattgcgaaatcaacaggagctaaagtaaagacattaagtccacttgaagctgctccaagcggaaacaagacatatctagaaaatcttagagcaaatttggaagtgctctatcaacagttgaag

SEQ ID NO: 744 - DNA, 720 bp, Streptococcus pyogenes
atgaatattagaaataagattgaaaatagtaaaacactactatttacatcccttgtagccgtggctctactaggagctacacaaccagtttcagccgaaacgtatacatcacgcaattttgactggtctggagatgactggtctggagatgactggcctgaagatgactggtctggagatggtttgtctaaatatgaccggtctggagttggtttgtctcaatatggctggtctaaatatggctggtctagcgataaagaagaatggcctgaagattggcctgaagatgactggtctagcgataaaaaagatgagacagaagataaaacgagaccaccatatggagaagcattaggtacagggtatgaaaaacgtgatgattggggaggacctggtacggtggcaactgacccttacactccaccatatggaggagcattaggtacagggtatgaaaaacgtgatgattggggaggacctggtacggtggcaactgacccttacactccaccatatggaggagcattaggtacagggtatgaaaaacgtgatgattggagaggacctggacatattcctaaacctgagaacgaacaatcaccaaacccacttcatattcctgaacctcctcagattgagtggcctcagtggaatggctttgatggattatcatttggcccctctgattggggccaatctgaggacacccctccaagtgaa

SEQ ID NO: 745 - DNA, 951 bp, Streptococcus pyogenes
atgagaaaagaggctcaaaaggacatgaaacaaatgaataaactcattacaggagtggtaacgctggcgacagtcgtgaccttatcagcttgtcaatcatcacacaacaacaccaaactcgtctcgatgaaaggagacaccatcactgtcagtgacttctacaatgagaccaaaaacacagaactcgcacaaaaagccatgttaagcttggtgattagccgcgtttttgagacacaatatgccaacaaagtctctgacaaagaggttgaaaaagcctataaacaaaccgcagaccaatacggtacatcctttaagacagtcctagcacaatcaggcttaacgccagaaacctataaaaaacaaattcgcctcacaaaattagtcgaatatgccgtcaaagaacaagccaaaaacgaaaccatctcaaaaaaagactaccgtcaggcctatgacgcttataccccaaccatgaccgcagaaatcatgcagtttgaaaaagaagaggatgccaaagcagcgcttgaagccgtcaaagctgaaggggcagactttgcagctattgccaaagaaaaaaccactgcagccgataaaaaaacaacctatacgtttgactcaggcgaaacaaccctaccagcagaagtagttagagctgcatcaggcctcaaagaagggaacagatcagaaatcatcacagcgcttgatccagccacctcaaaacgcacctaccatatcatcaaagtcaccaaaaaagcaactaaaaaagcagactggaaagcgtaccaaaaacgcttgaaagacatcatcgtgactggcaaattaaaagaccctgacttccaaaacaaagtcatcgctaaagctcttgataaagcaaatgtcaaaatcaaagacaaagcatttgccaatatcttagcccagtttgcaaaacctaaccaaaaacaacctgcccaaaaa

SEQ ID NO: 746 - DNA, 1194 bp, Streptococcus pyogenes
atgaataaaaagaaattaggtgtcagattattaagtcttttagcattaggtggatttgttcttgctaacccagtatttgccgatcaaaactttgctcgtaacgaaaaagaagcaaaagatagcgctatcacatttatccaaaaatcagcagctatcaaagcaggtgcacgaagcgcagaagatattaagcttgacaaagttaacttaggtggagaactttctggctctaatatgtatgtttacaatatttctactggaggatttgttatcgtttcaggagataaacgttctccagaaattctaggatactctaccagcggatcatttgacgctaacggtaaagaaaacattgcttccttcatggaaagttatgtcgaacaaatcaaagaaaacaaaaaattagacactacttatgctggtaccgctgagattaaacaaccagttgttaaatctctccttgattcaaaaggcattcattacaatcaaggtaacccttacaacctattgacacctgttattgaaaaagtaaaaccaggtgaacaatcttttgtaggtcaacatgcagctacaggatgtgttgctactgcaactgctcaaattatgaaatatcataattaccctaacaaagggttgaaagactacacttacacactaagctcaaataacccatatttcaaccatcctaagaacttgtttgcagctatctctactagacaatacaactggaacaacatcttacctacttatagcggaagagaatctaacgttcaaaaaatggcgatttcagaattgatggctgatgttggtatttcagtagacatggattatggtccatctagtggttctgcaggtagctctcgtgttcaaagagccttgaaagaaaactttggctacaaccaatctgttcaccaaatcaaccgtggcgactttagcaaacaagattgggaagcacaaattgacaaagaattatctcaaaaccaaccagtatactaccaaggtgtcggtaaagtaggcggacatgcctttgttatcgatggtgctgacggacgtaacttctaccatgttaactggggttggggtggagtctctgacggcttcttccgtcttgacgcactaaacccttcagctcttggtactggtggcggcgcaggcggcttcaacggttaccaaagtgctgttgtaggcatcaaacct

SEQ ID NO: 747 - DNA, 1533 bp, Streptococcus pyogenes
atgtctgtgaaagcgttatcgtttactaggaggattcgcatgataaacaaaaaaatatcacttggagttttaagtattctgacagccttttcgcttcaaagtgttagttatgcttgtactggttttattattggcaaagatttaaccaaagacggttctcttctttatggtcgaacagaagatcttgagccacaccataataaaaatttcattgtacgtctagcaaaggacaatcctgctggcgaaaaatggaaagacctctctaatggttttgagtaccccttgcctgagcattcttatcgctatagtgcgattcctgatgtaacacctaacaaaggcgtttatgacgaagctggttttaatgagtttggcgtctctatgtctgcaacagtatcagcttcagctaatgatgccatccaaaaaattgatccttacgtcaaaaatggcttagcggaatcatctatgaccagtgtcattttaccaagtgtcaaaacagcccgtgaaggtgtcgcattgatcgctaaaatagtcactgaaaaaggagctgctgaaggaaatattgttaccttggctgacaaagacggcatctggtacatggaaattctctctggtcaccaatacgttgccatcaaattcccagatgataaatacgctgtttttccaaataccttctatctcggacatgtcgatttcaatgataaggaaaatacgattgcctcagaagatgtggaaaaagtcgctaaaaaagccaaatcttataccgaagttgatggtaaatttcatattgccaaatcttacaatccaccactaaacgatgccaaccgctctcgctctttctcagggattaaatcacttgaccctgattcaaaagtaacttataaagacagcaattatgagttgctccaaagcactgataagaccttcagtctagaagatgcgatgaaactgcaacgtaatcgttttgaggggctggatcttaaaccacttgatcagatggcattagacggtaagggtaaaccaaaatccaaaaaagctgttaaaggttatgcttatcccatatcaaatcctaatgtcatggaagctcatattttccaactgaaaaaagacatccctgctgaattgggtggtgtcatgtggctatctattggcagtcctcgtaatgccccttacttgccataccttggcaatatcagtagaacctatgaagcctatcaagaaaaaagcacccaatataacgataagtcatggtattggacggtgtcacacattaatgatctcgtggctgctcatccaaaaccatttggaactaaagtgattgatgagatgaaaggcttggaaaaaacctggatagccgaacaagacaaaagcaccaaagaaatcagtgacttagtcgtcagtgaccccaaagctgctcaagaaaaagctgataagatttcactagatcgcgctgaaaaaaccttcaaacgcttaaaagctattgaagccaagttggttaaagaaaaacccaaaaacaagaaaggcttgaatagatca

SEQ ID NO: 748 - DNA, 384 bp, Streptococcus pyogenes
gtgaacaaaagatttaaaacaggatttctagcgcttgttgctatgctacttgttgcttgctcgcaaggaacaaaacaaatacagacgactccaagcgttccaaaagcagaccatcacgttcgcttagttgtcaaagaagataccaatactgttgacgaaaaagtttcttttggaaaaggagatacggtgcttgaggttctcaaagataattatgaggttaaagaaaaagatggttttatcacagcaattgatggtatcgagcaagacacgaaagctaacaaatactggctttttaaggtgaatggaaagatggcagataagggtgccgatcaaattaccgttaaagatggtgatagcattgaattttatcaagaagtttttaat

SEQ ID NO: 749 - DNA, 339 bp, Streptococcus pyogenes
atgacactaaaaaaacactattatcttctcagcctgctagctcttgtaacggttggtgctgcctttaacacaagccagagtgtcagtgcacaagtttatagcaatgaagggtatcaccagcatttgactgatgaaaaatcacacctgcaatatagtaaagacaacgcacaacttcaattgagaaatatccttgacggctaccaaaatgacctagggagacactactctagctattattactacaacctaagaaccgttatgggactatcaagtgagcaagacattgaaaaacactatgaagagcttaagaacaagttacatgatatgtacaatcattat

SEQ ID NO: 750 - DNA, 924 bp, Streptococcus pyogenes
atgacactactatctatcattgtcccctgctttaatgaagaagcaaacattctcccttattttgaagaaatgcatcaactagaaacgtccatgaccaaccaacttgcttttgaatacatttttattgatgatggttctaaggataacaccttgggtattttgcgtgagctagctgctcgctttccaaatgtgcattatctgtctttttcacgccattttggcaaggaagctgggctcttagctggactaaaagaagccaaaggcaattacattactgtgatggatgtggatctgcaagatccacccgaacttttgccaattatgtacgctaagctaaaagaaggttatgacatcgttggcaccaggcgccaaaatagacaaggagaaccactaattcgttcaatgtgttcgaatctattttatggactgatcaaacacttatcagatactgaaatggtcaatggagttcgggattatcggttaatgaccagacaagtcgttgatagcattcttgagttgggagaggttaatcgtttttcaaaagggatcttttcgtgggttggttatcgtatcacctatcttagttttgaaaaccaaaaacgcaaatatggaaaaagtcgttggcatttttgggagttgctccgatattctttagatggctttatcaacttttcagaaatgccgttaaccattgctacctggacagggactttcagctttttgatttctattttcgccatcttatttatcattatcagaaagatactctttggtgatcctgtctctggttgggccagcactgtctctattattttattcatgggaggcattcagctcttttgcatgggtattattggaaaatatatttcaaaaatattccttgaaactaaaaaaaggcctctctatattatcaaagaaaaacat

SEQ ID NO: 751 - DNA, 1284 bp, Streptococcus pyogenes
atgtcacatatgaaaaaacgtcccgaggtcttatcacctgctggaacacttgaaaaattaaaagttgcgattgactatggcgcagatgctgtttttgttggagggcaggcctatggcctaagaagccgcgctggtaacttctctatggaagaattgcaagaaggcattgattatgcacatgcgcgtggagctaaggtctatgttgctgctaacatggttacccacgaagggaacgaaattggtgcgggcgagtggtttcgtcaactgcgtgatatggggcttgatgcggtcattgtttcagatccagccttgattgttatttgttcaacagaagccccaggtttggaaattcatttgtcaacgcaagcttcatctaccaattacgagacctttgaattttggaaagccatgggcttgacccgagttgttttagctcgcgaggttaatatggccgagttagcagaaatccgcaagcggacagatgtggaaattgaagcctttgtccatggagccatgtgtatctcttattcaggccgctgtgttttgtcaaaccacatgagtcaccgtgatgccaacaggggcggctgctcacagtcttgccgctggaagtatgatttgtatgacatgccatttggaggagagcgccgctccttaaaaggggaaattccagaagactattctatgtcctctgttgacatgtgtatgattgaccatattcctgacctgattgaaaatggggttgatagcttaaaaattgaaggccgaatgaaatctatccactacgtctcaaccgtaaccaactgttacaaggcggctgtaggtgcttacatggaaagcccagaagctttttatgctatcaaagaggaattgattgacgagttgtggaaggttgcccagcgcgagttggctacaggtttttactatggtatcccaactgaaaatgaacaattatttggtgctcgccgcaaaattccacaatataaatttgtcggagaagtagttgcctttgactcagctagcatgacagcgaccattcgtcagcgtaatgtcatcatggaaggcgatcggattgaatgttatggaccaggtttccgtcattttgaaacggttgttaaggacttacatgatgcggatggccaaaagattgaccgtgccccaaatccaatggaactcttaaccatctctttaccgagagaagttaagccaggggatatgattagggcttgcaaggaaggtctggttaacctctatcaaaaagatggcaccagtaaaactgttagaaca

SEQ ID NO: 752 - DNA, 846 bp, Streptococcus pyogenes
atgagaagaaaaataaaacctattgttgtgctagtcttctttattttactggcaatggtattgattatcggaaaaagacaagctaatcatgcgaaacaaaaagaagttgaagacgctaagagtcatattcctattgcaaccagtaatcctggtaaagcaaaaactagcacttctgaaaccgaagactttattttaaatcctattgttgatgtttccggctggcaactccctgaagaaattgattatgacacattgtcacgtcacatctctggcgcaattgtacgtgtctatggaggatcgcaaattacagctcataacaacgctgcttttacaactggaattgacaaatcttttaaaacgcatatcaaagaatttcaaaaacgaaatgttcctgtagctgtttacagttacgcacttggtcgtagtactaaagagatgaaagaagaggcccgagctttctacaaaaacgctgctccctataatccaacttactactggattgatgtcgaagaagccactatgaaagatatgaataaaggcgtaacagccttccgagaagagcttaaaaaacttggtgctgaaaatgttggtctctatattggaacttattttatggcagaacaagatatttcaacaaaaggtttcgattctgtatggattccgacttatggtagtgattctggctattatgaggctgctcctaatacaaccttagattacgatttacaccaatacacctcacaaggttatctcagtggttttaacaatgctttagatttaaatcaaattgccgtaacaaaagacactaaaaaaacgtttgagaagttatttggcaactccaacaat

SEQ ID NO: 753 - DNA, 888 bp, Streptococcus pyogenes
atgtcagacaaacacattaatttagttattgtgacaggaatgagcggcgctggaaaaacagttgccattcagtcttttgaggatctaggctactttaccattgataatatgcccccagccttggttccaaaatttttagaattaattgaacaaaccaatgaaaatcgtagggtggctttggttgtcgatatgagaagtcgtttgtttttcaaggaaattaattctaccttagatagtattgaaagcaatcctagcattgattttcggattctttttttggatgcaacggatggagaattggtgtcacgctataaagaaaccagacggagccaccctttggctgcggacggtcgtgtgcttgatggtattcgattggaaagagaactcctatctcctttgaaaagcatgagccaacatgtggtggatacaacaaaattgacccctagacaattgcgtaaaaccatttcagaccagttttctgaagggtctaatcaagcctctttccgtattgaagtgatgagctttgggttcaaatatggtcttcctttggatgcggatttggtttttgatgtgcgttttctacccaatccttattatcaggtagagcttcgtgaaaaaacaggactagatgaggacgtttttaattatgtgatgtctcacccagaatcagaggtgttttacaagcatttgttaaaccttattgtccctatcttaccggcttaccaaaaagaagggaagtctgtcttgacggtggctattggctgcacaggaggccaacaccgcagcgttgcctttgcccattgcttggcagaaagtctggcaacagattggtcggttaatgaaagccatcgtgatcaaaatcgtcgtaaggaaacggtgaatcgttca

SEQ ID NO: 754 - DNA, 1053 bp, Streptococcus pyogenes
atgaaatatcaacttaatagtaatgttcgtgtcgtgacatttcaagatacattttgttttagaaaaggaatctgggactttaatgaagccattctagatttgacacaagaacctcaaaatttaaagatagtttatcaagaaatagtttcacagttggttaagggagtagccattgatactgaaacttatgaaaatactttagaacctgagacgttcgctaatttaatggaagtcatttcaggcttgtattacaatgatatgctgatgcttgaggatgactacaatcttgaagaaaatgtcatgaaaattttaatgggtaatttccgttttatggcgcaagcaggtcatatggtaagcaatgatcctgttttgtttatcagtgattcgacttatgttaatgaatctgctgagttgctagctgaacaactgcatttacaattgcaagtggctagtgatgacttaaaaatgttaattcagcagacagatgttagttcgcgtttagatgctttggagcatcgccgtaacatgaattgtttatcagatgccttgtgcgattaccaaagtattattatttgtcaagaacgcttgaatattatgatgttgcgacacttgaatgaagttagcgtagctatgaaaaaacaattagtgattggttttgtagatggaccattcttgcacacttgtactttgaatcctccccatagtgctgactttgatagcttagaaagaagagttttggcacgtttacaagactcaactctctatcaacattttgctaatcaggttttaccagccacacaagatgtgagccaggcctatttaccattgttaaatgttttaatgaatttagtcgttagcgaagctttcattattgctcaaacaggtagttctaaatttgagggacgtttattaagcatttacttaccgacgcttgagattcaggtccaagatattttgaaaatgtctaattcacagacacaaggagctttggcaaaattaaagtatgaggatcagcagatatcaacacgtgagattgttaaaaaactccttgac

SEQ ID NO: 755 - DNA, 2730 bp, Streptococcus pyogenes
atgattaacaagaaatgtataatacctgtttcattgttgacactagctattacgcttactagtgttgaagaagttacttcacgccaaaatttgacttatgccaatgaaatcgtaacacaaaggccaaagagagaatctgttattagtgataaatcgaattttcccgtcatatcaccttacctagcaagtgtggattttggtgagagaaaaacacctttgccaacacctgataaaggagtaaaagtaactactgaacagtctattgctcaagtaagaaaggggcctgaagaaagaccctatactgttactggcaagattacgagtgtgatcaatggctggggaggctatggcttttatattcaagatagtgaaggtattggactttatgtttatcctcaaaaagatttaggatacagtaagggagatattgttcaattaacaggtacacttactcgctttaaaggtgatttacaactccaacaggtgactgcacacaaaaagttagagttatcttttccgacttctgttaaagaagcagtaatatcagaattagaaacaacaacaccctcaacattagttaagttatctcacgtgacagttggagaattatcaactgatcaatataacaacacatctttccttgtaagggatgatagtggtaaaagtatagttgttcatatagatcatcgtacaggggttaaaggggctgatgttgttactaaaataagtcagggtgatttgattaacctcacagccatattgtctattgttgatggtcaattacaattaagaccgttttctcttgaacaattggaagtggttaaaaaggtcacaagctcaaatagtgatgcttcatctcgtaatattgtgaaaataggcgagattcaaggagctagtcatacgtcgccacttctcaaaaaagcggtcaccgtagaacaggttgttgtcacttatttagacgattccactcatttttatgttcaagatcttaatggtgatggtgatttagcgacttcagatggtattcgtgtttttgctaaaaacgctaaggttcaagtcggcgatgttttgaccatttcaggtgaagtggaagaattctttggtcgtggttatgaggaacgtaagcagactgaccttaccatcacccaaattgtggctaaagcagtgaccaaaacagggacagctcaagttccatcaccgcttgttttagggaaagatcgtatcgcgccagccaatattattgataatgatggcttgcgtgtgtttgatccagaagaagacgctattgattattgggaatcaatggaaggcatgttagtggcggttgatgatgctaaaatccttggtccaatgaaaaataaagaaatttatgtcttacctggctctagtacaagaccgttaaataattcaggtggagtattacttccagctaattcttataacacagatgtgattcctgttcttttcaaaaaaggcaaacaaattattaaagcaggagactcttacaaaggaagattagctgggccagtatcttatagctatggtaattacaaggtctttgttgatgacagcaaaaacatgccaagtttaatggatggtcatctaaaacctgaaaaaacaaacttgcaaaaagaccttagcaagttaagcattgcttcttacaatattgaaaacttctcagccaatccttcttcaactaaagatgagaaggtcaaacggattgccgaatcctttattcatgatctgaatgctccagacattattggattaattgaagtccaagataataatgggccgactgatgatgggacaacggatgcgacacaaagcgcgcaacgcctcattgatgctattaaaaaactaggtggcccaacttatcgttatgttgatattgctccagaaaataatgttgacggaggtcaaccaggtggtaatattcgaacaggattcctttatcaaccagagcgcgtcagcctttctgataagccaaaaggcggtgctcgtgatgctctaacttgggttaatggagaattaaaccttagtgttggtcgaattgatccaactaacgccgcttggaaagatgttcgtaaatcactagcagcagaatttatcttccaaggtcgtaaagtcgttgttgttgcaaatcatttgaactctaagcgtggggataatgctctttatggttgtgtgcaaccagtcacttttaaatctgagcaaagacgtcacgtcttggctaatatgctagcacaatttgcgaaagaaggggcaaaacaccaagctaatattgtgatgctaggtgactttaatgattttgaattcacaaagacgattcaattaatcgaagaaggtgacatggttaacttggtgagccgacatgatatttcagatcggtattcttattttcaccaaggcaataatcagacccttgataatatattagtttcacgccatttacttgatcactacgaatttgacatggttcatgtgaattccccatttatggaagctcacggacgcgcatcagatcatgatccattgttacttcaattatcattttccaaagaaaatgataaggcagagtcttctaaacaaagtgtaaaagctaaaaaaacttcaaaaggaaaactgttgccaaaaacaggagatagtcttgtttatgtgataacgctactaggaacggctagtttattagtgcctattttattattgactaaaggcaaaaaggaatca

SEQ ID NO: 756 - DNA, 360 bp, Streptococcus pyogenes
atggttaaagaattaaaagcatttttgtttagaggaaacattattgaacttgctgtagcagttatcatcgggggagcttttggtgctattgtcacttcttttgtgaacgatattatcacaccgcttattttaaacccagctttgaaagctgcaaatgttgaaaacatcactcaattgtcatggaatggtgttaaatatggtagctttttaggagccgttattaattttcttatcatcggtaccagtcttttctttgttgtaaaagccgctgaaaaagctatgcctaaaaaggaaaaagaagctgcagctcctactcaagaagaattattgacagaaatccgtgatttgttggctcaaaaa

SEQ ID NO: 757 - DNA, 474 bp, Streptococcus pyogenes
atggctaaagaaccatgggaagaaaaaattgttgatgatactatagggacacgaacacgtaaatcaagaaatgctttcattagcacgccttggttgactgctttattaagtgtattctttgtcatcattgttgctatactttttattttcttctatacatcaaatagcggtagtaatagacaagctgaaacaaatggtttttatggagcatccactcataaaaaaacaaggaaagcttctaacgctaaaaaaacatcaagtagttcaacaactacagacacaacaccttctagcgaagaaacacttgcttctagtgaaggaactggcgaaacccttactgtattggcaggtgagggggcagcttctattgcagctcgtgcaggtatttctgtggagcagttacaagcacttaatccagagcacatgactcaaggatattggtatgccaatccaggagatcaagtcactattaaa

SEQ ID NO: 758 - DNA, 1269 bp, Streptococcus pyogenes
atgtctaaaagaggaaaaattaaaataacaacgaaaacaaagcttattacagctagtgttataacgctagtattaattataactggaatagtcttgtggaaacaacaacgaaatacgctaacagctgatatcgctaaagaaccttactctactgttagtgtaactgaagggagtattgcttcttcgactttactatcaggtactgtaaaggctttatcagaggaatatatttattttgatgctaataaaggaaatgatgcaactgttacagttaaagtaggtgatcaggtaacgcagggccagcaattagttcaatataatacaacaacagctcagtcagcttatgatactgctgttaggagtcttaacaagattggccgacaaattaatcatcttaaaacatacggagttcctgctgttagtacagaaactaatagagatgaagctaccggtgaagagacgacaacaacagttcaaccatcagctcagcaaaatgctaattataaacagcagctgcaagatttaaatgatgcttatgcagatgcacaagcagaagtaaataaagcgcagatagcgttaaatgatacagtagttatcagtagtgtctctggaactgttgtggaagtaaataatgatattgatccttcttcaaagaacagtcaaacacttgttcacgtagcaaccgaaggacagcttcaggtgaaaggaacattgacagagtatgatttagcaaacgttaaggttggtcaatctgtaaaaattaagtctaaagtttattctaatcaagaatggactggaaaaatatcatatgtttcaaactatccaactgagtctaatgcaggttcaacaacgccagcaggtagcactggagcgggaagttctacaggagctacctatgattacaagattgatattataagtcctctcaaccagcttaaacaaggcttcactgtttctgttgaggttgttaatgaagcaaaacaggccttagttcctttaacggctgttattaagaaagataaaaaacactatgtttggacttatgatgatgctactggcaaagccaaaaaagtagaggtgacacttggaaacgcagatgcacaacaacaagaaattcataaaggagtagctgttggtgacattgttattgccaatccagataaaaatatcaaaccggataaaaaactagaaggggttatttcaataggtaccaacacaaaaccggaaaaagattctcaatcaaagaataaaaaatcaggggtggataaa

SEQ ID NO: 759 - DNA, 3024 bp, Streptococcus pyogenes
atgaagaaacatcttaaaacagttgccttgaccctcactacagtatcggtagtcacccacaatcaggaagtttttagtttagtcaaagagccaattcttaaacaaactcaagcttcttcatcgatttctggcgctgactacgcagaaagtagcggtaaaagcaagttaaagattaatgaaacttctggccctgttgatgatacagtcactgacttattttcggataaacgtactactcctgaaaaaataaaagataatcttgctaaaggtccgagagaacaagagttaaaggcagtaacagagaatacagaatcagaaaagcagatcacttctggatctcaactagaacaatcaaaagagtctctttctttaaataaaacagtgccatcaacgtctaattgggagatttgtgattttattactaaggggaatacccttgttggtctttcaaaatcaggtgttgaaaagttatctcaaactgatcatctcgtattgcctagtcaagcagcagatggaactcaattgatacaagtagctagttttgcttttactccagataaaaagacggcaattgcagaatataccagtagggctggagaaaatggggaaataagccaactagatgtggatggaaaagaaattattaacgaaggtgaggtttttaattcttatctactaaagaaggtaacaatcccaactggttataaacatattggtcaagatgcttttgtggacaataagaatattgctgaggttaatcttcctgaaagcctcgagactatttctgactatgcttttgctcacctagctttgaaacagatcgatttgccagataatttaaaagcgattggagaattagctttttttgataatcaaattacaggtaaactttctttgccacgtcagttaatgcgattagcagaacgtgcttttaaatcaaaccatatcaaaacaattgagtttagaggaaatagtctaaaagtgataggggaagctagttttcaagataatgatctgagtcaactaatgctacctgacggtcttgaaaaaatagaatcagaagcttttacaggaaatccaggagatgatcactacaataaccgtgttgttttgtggacaaaatctggaaaaaatccttctggtcttgctactgaaaatacctatgttaatcctgataagtcactatggcaggaaagtcctgagattgattatactaaatggttagaggaagattttacctatcaaaaaaatagtgttacaggtttttcaaataaaggcttacaaaaagtaaaacgtaataaaaacttagaaattccaaaacagcacaatggtgttactattactgaaattggtgataatgcttttcgcaatgttgattttcaaaataaaactttacgtaaatatgatttggaagaagtaaagcttccctcaactattcggaaaataggtgcttttgcttttcaatctaataacttgaaatcttttgaagcaagtgacgatttagaagagattaaagagggagcctttatgaataatcgtattgaaaccttggaattaaaagataaattagttactattggtgatgcggctttccatattaatcatatttatgccattgttcttccagaatctgtacaagaaatagggcgttcagcatttcggcaaaatggtgcaaataatcttatttttatgggaagtaaggttaagaccttaggtgagatggcatttttatcaaatagacttgaacatctggatctttctgagcaaaaacagttaacagagattcctgttcaagccttttcagacaatgccttgaaagaagtattattaccagcatcactgaaaacgattcgagaagaagccttcaaaaagaatcatttaaaacaactggaagtggcatctgccttgtcccatattgcttttaatgctttagatgataatgatggtgatgaacaatttgataataaagtggttgttaaaacgcatcataattcctacgcactagcagatggtgagcattttatcgttgatccagataagttatcttctacaatagtagaccttgaaaagattttaaaactaatcgaaggtttagattattctacattacgtcagactactcaaactcagtttagagacatgactactgcaggtaaagcgttgttgtcaaaatctaacctccgacaaggagaaaaacaaaaattccttcaagaagcacaatttttccttggccgcgttgatttggataaagccatagctaaagctgagaaggctttagtgaccaagaaggcaacaaagaatggtcagttgcttgaaagaagtattaacaaagcggtattagcttataataatagcgctattaaaaaagctaatgttaagcgcttggaaaaagagttagacttgctaacaggattagttgagggaaaaggaccattagcgcaagctacaatggtacaaggagtttatttattaaagacgcctttgccattgccagaatattatatcggattgaacgtttattttgacaagtctggaaaattgatttatgcacttgatatgagtgatactattggcgagggacaaaaagacgcttatggtaatcctatattaaatgttgacgaggataatgaaggttatcatgccttggcagttgccactttagctgattatgaggggctcgacatcaaaacaattttaaatagtaagcttagtcaattaacatctattcgtcaggtaccgactgcagcctatcatagagccggtattttccaagctatccaaaatgcagcggcagaagcagagcagttattgcctaaaccaggtacgcactctgagaagtcaagctcaagtgaatctgctaactctaaagatagaggattgcaatcaaacccaaaaacgaatagaggacgacactctgcaatattgcctaggacagggtcaaaaggcagctttgtctatggaatcttaggttacactagcgttgctttactgtcactaataactgctataaaaaagaaaaaatat

SEQ ID NO: 760 - DNA, 1071 bp, Streptococcus pyogenes
atgcgtaaactttattcctttctagcaggagttttgggtgttattgttattttaacaagtctttctttcatcttgcagaaaaaatcgggttctggtagtcaatcggataaattagttatttataactggggagattacattgatccagctttgctcaaaaaattcaccaaagaaacgggcattgaagtgcagtatgaaactttcgattccaatgaagccatgtacactaaaatcaagcagggcggaaccacttacgacattgctgttcctagtgattacaccattgataaaatgatcaaagaaaacctactcaataagcttgataagtcaaaattagttggcatggataatatcgggaaagaatttttagggaaaagctttgacccacaaaacgactattctttgccttatttctggggaaccgttgggattgtttataatgatcaattagttgataaggcgcctatgcactgggaagatctgtggcgtccagaatataaaaatagtattatgctgattgatggagcgcgtgaaatgctaggggttggtttaacaacttttggttatagtgtgaattctaaaaatctagagcagttgcaggcagccgagagaaaactgcagcagttgacgccgaatgttaaagccattgtagcagatgagatgaaaggctacatgattcaaggtgacgctgctattggaattaccttttctggtgaagccagtgagatgttagatagtaacgaacaccttcactacatcgtgccttcagaagggtctaacctttggtttgataatttggtactaccaaaaaccatgaaacacgaaaaagaagcttatgcttttttgaactttatcaatcgtcctgaaaatgctgcgcaaaatgctgcatatattggttatgcgacaccaaataaaaaagccaaggccttacttccagatgagataaaaaatgatcctgctttttatccaacagatgacattatcaaaaaattggaagtttatgacaatttagggtcaagatggttggggatttataatgatttatacctccaatttaaaatgtatcgcaaa

SEQ ID NO: 761 - DNA, 729 bp, Streptococcus pyogenes
atgaaaaaagaatttaccagtatcctgtttacagttagtttttgtggaatcatagcattgcctgtcgaagctagtggccctaaagttccttatacacaagaaggtataacggccatttcaaatcaggcaacagtaaaattgatttctattgctgatatcgcgagcagtttagaaggacaaaaacctataacggttagttttgatatcgatgatactttgttatttactagccaatattttcagtacggcaaagaatatataactccaggctcatttgattttttgcataagcaaaaattttgggacttggtcgctaaacggggagatcaggattctattccaaaagagtatgcaaagcaactaatcgcaatgcatcaaaaacgaggagataaaattgtctttattactggccgaactcgaggatcgatgtataaaaaaggtgagattgataaaacagctaagtcactggctaaagattttaagttagacaagccaatagctatcaattatacaggagataaagctgtgaagccgtatcagtatgataaaacatattatataaagaaaaacggctcacaaattcattacggagatagtgatgaagatataaatgctgccaaagaggcaggtgcaagacctattcgcattttaagagctcctaattcaaccaatcttcctttgccaaaagctggaggatacggagaagaggttttagaaaattcggcttat

SEQ ID NO: 762 - DNA, 747 bp, Streptococcus pyogenes
atggtaaaaaaacaaaagcgtcgaaaaataaaatccatgtcttgggcaagaaaactactaatagctgtacttttaattctaggtttagcattgctttttaacaaacctatccgaaatacattaattgctcgaaactctaataaatatcaagtaacgaaagtttcgaaaaaacaaatcaaaaagaataaagaggctaagtcaacatttgatttccaagccgtagagccagttagtacagagagtgtcttgcaagcacaaatggcggctcagcaacttcctgttatagggggcattgccataccagagcttggcattaatttaccaatttttaaaggtttaggaaatactgagcttatttatggcgcaggaacgatgaaagaagaacaagttatgggaggagaaaataattattctcttgccagtcatcatatttttggaattacaggttcatctcaaatgctcttttcgccgcttgaaagagcacaaaatgggatgtccatctatttaacagataaagaaaaaatttacgaatacatcataaaagatgttttcacggtagctcctgaacgcgttgatgttatcgatgatacagctggtctcaaagaagtgactttagtgacttgtacagatatcgaagcaacagaacgtattattgtcaaaggagaactaaaaacagaatacgattttgataaagcgcccgccgatgtattgaaagcttttaatcattcttataaccaagtatctacc

SEQ ID NO: 763 - DNA, 2133 bp, Streptococcus pyogenes; identical to SEQ ID NO: 730

SEQ ID NO: 764 - DNA, 651 bp, Streptococcus pyogenes
atgggaaaagaaataaaagtgaaatgctttttgcgtagatcagcttttggattagttgcggtgtcagcatcagtattagtcggttcaacagtatctgctgttgactcacctatcgaacagcctcgaattattccaaatggcggaaccttaactaatcttcttggcaatgctccagaaaaactggcattacgtaatgaagaaagagccattgatgaattaaaaaaacaagctattgaggataaagaagctacgacagctatagaagcagcaagttcagatgccttagaagcattagcggatcaaacagacgctttacaatcagaagaagctgcggttgttaaagcggataacgctgctagtgacgccttagaagcattggcggatcaaacagacgctttacaatcagaagaagctgaagtagttcaatcagataacgctgctagtgacgcctgggaaaaagcagcaactccaatcgctttagatgttaagaaaactaaagatacaaaacctgtagttaaaaaagaagaaagacaaaacgttaatacccttcctacaactggtgaagagtctaacccattctttacagctgctgcgcttgcaataatggtaagtacaggtgtgttagttgtaagttcaaagtgcaaagaaaat

SEQ ID NO: 765 - DNA, 1272 bp, Streptococcus pyogenes
ttgaaaaaattaaatgttattcttgttggtttattaagcattctgatgttgagtttagctattgtgtttattaatcgttggaaactaaacgaagatagtcagcgtatagttttggctgaaaagaaaaaaaacacgtcagatttagtgatcaaagctgtaaaacatattaaaaaagatcaaaaagactattattatttttccccgataaaacaagcagatgatttttttgtagataatttacctgtttcattatacaaaaaaaagaattcagataaagaattgattttagtaaggcctaaactgcaatcttctcacctaagatcagttaacactttgactatttctaaaatagtttatcagaaaaaattttttcatttggctaaaaaatcagaaaaagttataagtacatatcacgttacagacgacttgaaaccgtttcaggtaaaggatctagtatcaggacatttagaaagaatacaagaagaagttgaaaaaaaatatccagatgctggttttaatagcgataagtataatggcttaaaagaatctaattctttattaagcgatggctttgaggtaaaatcgggaaaccttatttttgataaaaagctaacgatacctttgacgacattatttgatgttattaatccagattttttagcaaatagcgatagagctgcgtatgataattataggacctacaaagaacagcatcccaaaaaactagttgcattaacgtttgatgatggtccagatccgacgacgactcctcaagttttagatattttggcaaaataccaggctaagggaactttctttatgataggttcaaaggttgtgaataatgaaaaccttactaaacgtgttagcgacgctggccatgaaattgctaatcatacttgggatcatcctaatctgactaatctttcagtcagcgagattcaacatcaagttaatatgacgaaccaggctattgaaaaagcttgtggcaagaaacctcgctatttacgccctccatacggagctacaaatgcaactgttcagcaatcctcaggattaacacaaatgctttggacggttgatacaagagattgggaaaatcatagcactgatggcattatgactaatgtcaaaaaccaattgcaaccgggaggagttgttttaatgcatgatattcatcaaacaactatcaatgctttgccgacagttatggaatatctaaaagcagaaggatacgaatgtgtgactgtatcagaactctatgcgcatcag

SEQ ID NO: 766 - DNA, 939 bp, Streptococcus pyogenes
atgactagtaaaaaagcgtgtttatcaagcatcattgtgttagcaagtttaacgtgtggaaatgatactgttagtgccaatcatctctcagcaactggagataagtttgatgattgctcaacacttgttgaaaaagatgtggcccctaaagatgaacttgagatgttagcatggtcctcgtctcaaacaactgatgatgctgacagagactatgaagattttctcgatgatgattcttttatttctcaaaatgaaactgataagatgtttgagaatttaactgatgataggttattaaatgaattagatgaattagatgaagaaaatgaagaagatgaagaagatacaattgagccagagcaaaatgtaataatgcctagtgacgatgagctatttgatttaactgatgctgttgagacacgccttactgtttctagtgctccccatttagaggctgaattgccgaaaccacatttgaggagcctatcagatacagcactgcggtctggtgaaattagaggacatttagataacaaactggacgctttgtctgtaacagctacaaagttagcattaacgatggctcaaaaatttgatttgacaacgcatgtctattctataggtgaaagctttagtgaagtattagctgctcattatgaagacagaaaagcagaatcagctttttctaagaaaaagagatttcaccttcctattgctactccagatgttgttatagaggagttaaggcgcctagtctcttctattggaagttcaaaagaagatgtttcagttccttatagtcggaagctaggtatggcagttgcaaaaagaaaaatagccctgccacaaacgggagagaggttctcttattatccagttttacttggtttaatgatattaggattaacgccgattatgataccaaagaagataaataat

SEQ ID NO: 767 - DNA, 1071 bp, Streptococcus pyogenes
atgccacaaacacttcatgtccattctcgggtcaaggattatgatatcctgtttaccgaccatgttttaaaaaccttagcagattgccttggtgagcgcaagcagcgtaaactcttgtttatcaccgatcaaacggtctaccacttgtatcagactctctttgaagaatttgctcagcaatacaacgcttttgtccatgtctgccctccgggaggtcaatccaaatccttggaacgtgtcagtgctatctacgaccagctcatcgctgaaaatttttccaaaaaagatatgattgttactattggtggtggtgttgttggggatctgggtggttttgtcgctgcaacctattaccgtggtattccctacattcaaatcccaacgactttacttagtcaggtggatagcagtatcgggggcaaagttggagtccattttaaaggtctaaccaatatgattggcagcatttaccctccagaagctatcattatttcaaccacctttttggagaccttaccgcaacgggaattctcctgcggcatcagtgagatgctcaaaatcggcttcattcatgatagaccgctttttcagcagttacgtgattttcaaaaagaaaccgataagcagggacttgaacgtctgatttaccaatccatttccaataaaaaacggattgttgaacaagatgaatttgaaaatggtttgcgcatgtctttaaattttgggcataccttgggccacgcgattgaatcgctctgccaccatgatttttaccatcacggtgaagccattgctatcggtatggtggttgatgctaaactggctgtttccaaaggactcttgccaaaagaggacttggatagcctccttcaagtttttgaacgttaccagttaccaacaacacttgaaagagctgatgtctctgcgacatccctctttgacgtctttaaaacagataagaagaattctgagcaacatattatctttatattacccacagaaaccggttttaccaccctagccattaacaaagacgatcaccaatttgtcgagaagctcgacagtttatta

SEQ ID NO: 768 - DNA, 2163 bp, Streptococcus pyogenes
gtgattacaattaaaaatccaaaaatccttaagtggctaaagtatgtattaagtgcaattcttagccttattatccttgttattattattggtggtcttttgtttaccttctacattagcagtgctccgaaactgtcagaagcccagttaaaatcaacaaactctagcttggtttatgacggtaataacaatctgattgctgatttgggttctgaaaagcgtgaaaatgtaacagctgatagtatccctattaatctagttaatgctattacctcaattgaagataaacgtttctttaaccatcgtggagtagatctttatcgtatttttggtgctgcctttcataatctaacgagtcagaccactcaaggggggtcaacgcttgatcagcaactcattaaactagcctatttttctactaatgaatctgatcaaaccttaaaacgtaaggctcaagaagtttggcttgctcttcaaatggagcgaaaatatactaaacaagaaatcctgactttttacatcaacaaagtatatatgggtaatggcaactatggtatgctgacagccgctaagtcttattatggcaaggatcttaaggatttatcttatgcccaactagccctattggctggaatccctcaagctcctagtcaatatgatccttaccttcatcctgaagctgctcaaaatcgccgtaacgtcgtgttgcaacagatgtacatggaaaaacatctgacgaaagcagaatatgaaactgccatcgcaactcccgtcgctgaaggtctacaatcactccaacagcgctcaacttatccaaaatatatggataattatctaaaacaagttattgaagaagtcaaaaaagaaacgaataaagatatttttaccgctggtttaaaagtttataccaatattatccccgatgcgcagcagactctttataatatttatcattctggtgattatgtttactatccagaccaagatttccaagttgcttcaacgattgttgatgtgacaaatggtcatgttattgctcagcttggcggacgtaatcaagatgaaaatgtttcatttgggactaaccaagctgttttaactgatcgtgactggggttctaccatgaagccaatcacagcctatgctcctgctattgaatctggtgtttatacttctactgctcagtcgactaatgactcagtctattattggcctggaaccactacccaattgtttaactgggaccttagatataacggatggatgacaatccaagctgctattatgctatcgcgaaatgtcccagcagtccgagcactggaagccgcaggacttgactatgctcgatctttcttaagcagtttaggtattaactatcccgaaatgcactactcaaacgctatctcaagtaataacagtagctcagataaaaaatatggtgcaagtagtgaaaaaatggccgctgcatacgctgcttttgcaaatggtggtatttatcataaaccaaggtatgtcaataaagtggaatttagtgatggtacaagtaaaacttttgatgaaaaaggaaaacgtgccatgaaagaaaccacggcctatatgatgacagatatgttaaaaactgttctcacttatggtacaggtactgctgctgccattcctggtgttgcgcaagctggtaaaacagggacttctaactacactgatgaggaactagctaaaattggtgaaaaatacggcctttatccagattatgttggtacattagcgccagacgaaaactttgttggctttactaagcgctacgccatggctgtttggacaggttacaaaaaccgcttgaccccagtatacggatcaagtctagagattgcatctgacgtttatcgtagcatgatgacttacttaacaaatggttacagtgaagattggacgatgccaaatggtctttatcgcagtggtggattcctctacttaagcggaacctatgcgagcaacaccgactatactaattcggtttacaacaatctttacagcaataacacgacaacagcttctagccaaacgacttcagatgatactagtagtagcaatgatacaagtaattcaaccaatacagacaacaatggcagtcatccatctaccgatgataaaaagacaactcat

SEQ ID NO: 769 - DNA, 720 bp, Streptococcus pyogenes
atggctacgatgaaacaatatcataaaggagattccatgactaaatcacaaaaagaggcgctttattggatgttgagtgttctaactatcactctaataggtggctcctgccttatttttggatcccaccctcaaacgcaagataaggtagctaaacattctaaaagtgctgctagtttactaaaaaaagcagttaaagcagttaatgacgctgatcgtttagccactgcagctgctatccaagaagcccagaaagctgttgataaattagcagaatcttctaagaaaaaaacgctacaagaacagctaaacgttgccaaagcaaagcaagagcaagaagatgcagctactcaagcagttaaagctgctgaggagactctcaatcaaaatcttaaagatatcgcccaaaaagcagttaacgacttaagtaacaaaggtaaaaaagccgctttacaatctcggttagacgctattttaccagcgaaacccattattgatgaatttccaagacaaagtggagaaataacagataactcttactggacacctttcccaggagacgtctcagatacttatgataattcccagtcacctactttagacccaagctcagaatcttcagcttcagatgttacaccacaacctagtcatcctgatccaattccacctcagacctcttcagaaccttccgactcaggagacaagcaatcatcaaaagag

SEQ ID NO: 770 - DNA, 984 bp, Streptococcus pyogenes
ttgaaacatcctattcgaaaaacacttgtcaccttaggtctattactgaccttatgcctgccgactccagttgcagctagttctcgttcttggaagagctggtttatcgagcaatatttctggttaaaacgtgacaagagttactattctaaacaagatgacccaagcttccaaagataccttgatgcctgtcgtgaacaatctgataaaccttatcaactagatactaatttagtcaatggtccccttgttcaagaaaatctttatggcatgcaggtttactcttggaatgataatggaaaacctgatcaaaaaacaattatttatcttgccggtggttcttatcttaacaatccaacgacataccatattaatatgttaaagacattatccacaagtcttgacgctaaaattgttttacccatttatcctaaagccccacgttatacctataactatactatgccaaaattggtcaatctttaccaacactattaccataaaaatcagaatgttttccttatgggagattcagcaggtggaggtttagccttaggtctagctcatgccctacacaatgaatcagtccctcaaccaaagcagctcgttcttttatcaccttggttagatgttactatgtcacacccagagattccagaatacgaagatgctgatcctattctatcttcttggggattaaaacgagtgggagaattgtgggcctactctgctgataataccaaccatatttatgtcagtcctaaaaatggtccgatcacttatctaccaccaattactttatttactgggacacgagagatcttttatcctgatattcgcgattatgccgcaaaactgaaagccgctaaccacaatattacctttattacccaagaaggcatgaaccacgtttacccaatttatcctatcgaagaggcaaaaacagctcaataccaaatcattgatgccatcaacaaaactcct

SEQ ID NO: 771 - DNA, 873 bp, Streptococcus pyogenes
atgacaaaggtagtaataaagcaattgttgcaggtaatagtagtgttcatgataagtttatcgacaatgacaaatcttgtgtatgcagataaaggtcaaatttatggatgtattattcaaagaaattatcgtcatccgatatctgggcagatagaagatagcggaggggagcattcctttgatattggtcaaggtatggttgaaggaactgtctatagtgatgccatgctagaagtatctgatgctggaaagatcgttcttacttttcgtatgagcttagctgattattcgggcaattatcagttctggatacaacctggaggaactggaagctttcaggcagttgattacaatatcacccaaaaaggtactgataccaatgggacaacactagatattgctattagtttgcctactgtaaatagtatcattcgaggcagcatgtttgttgaacctatgggcagagaagtggtcttttacctgtcagcttcagagttaatacaaaagtattcaggtaatatgttggcccagcttgttactgaaacagacaattctcaaaatcaagaagtaaaagacagtcaaaagcctgttgatacaaaactaggagaaagtcaagatgagtctcacacaggtgctatgataactcagaataagcctaaagccaactcatcaaataacaagagtctatcagataaaaaaattcttccttctaagatgggcttaacgacttctttagagttaaaaaaagaagataagtttcggtctaaaaaagacttatcaatcatgatttactactttccaactttttttctgatgttaggagggtttgctgtatgggtttggaaaaagaggaaaaaaaatgataaaacgatg

SEQ ID NO: 772 - DNA, 3495 bp, Streptococcus pyogenes; identical to SEQ ID NO: 656

SEQ ID NO: 773 - DNA, 1044 bp, Streptococcus pyogenes
atgttgacatcaaagcaccataatctcaacaaactagtctggcgctacgggctaacctcagccgctgccgtccttctagcctttggaggcggggcaagcagcgttaaggctgaggtttcttctacgactatgacgtcgagtcaaagagagtcaaaaataaaagagatcgaagaaagtcttaaaaaatatccagaagtgtccaatgagaaattttgggaaagaaagtggtatggaacctattttaaagaagaagattttcaaaaggagctaaaagattttactgagaagaggcttaaggagattctagatttaattggtaaatctggaatcaagggagaccgtggtgagactggtcctgctggcccagccggaccacaaggtaaaactggtgagaggggcgcccaaggtcctaaaggtgaccgcggtgagcaaggaatccaaggtaaagctggtgaaaaaggtgagcgcggtgaaaaaggcgacaaaggtgaaaccggtgaacgcggtgaaaaaggcgaagctggaatccaaggcccacaaggtgaagctggtaaagatggcgctccaggtaaagatggagctccaggcgaaaagggtgaaaaaggtgaccgcggtgaaaccggagctcagggtccagtaggcccacaaggtgaaaaaggtgaaacgggcgcccaaggcccagcaggcccacaaggtgaggcaggcaaaccaggtgagcaaggcccagcaggcccacaaggtgaagcaggccaaccaggcgaaaaagctccagaaaagagcccagaaggcgaagcaggccaaccaggcgaaaaagctccagaaaagagcaaagaggtaactccagctgcagaaaaacctgctgacaaagaagctaaccaaacgccagaacgccgcaatggcaatatggctaagacacctgtagccaacaaccacagacgtctaccagcaactggtgagcaagccaacccattctttacagcagcagcagtagcagtgatgacaacagctggtgtcctagccgttacaaaacgcaaagaaaacaac

SEQ ID NO: 774 - DNA, 1137 bp, Streptococcus pyogenes
atgcgtagagcagaaaataacaaacacagccgctattccattcgcaaactgagcgttggggtaacgagtatagcaattgcgagtctctttttaggaaaggttgcctatgccgtagatggcatccctccaatctctcttactcaaaagactacagccactacatcagaaaattggcatcatattgataaggatggccttattcctttaggtataagcttagaagctgccaaagaggaatttaaaaaagaagtagaagaatcacgtttatctgaagcacaaaaagaaacgtataaacaaaaaattaaaactgcaccagacaaagataagctattattcacgtatcatagtgagtatatgacagccgttaaggatcttccagcgtctactgagtctactactcagccagttgaggcacccgtgcaggagacacaggcatcagcttcagattcgatggtgacaggtgattcaacatcagttacgactgattctcctgaggaaaccccatcttcggaaagtccagtggccccagctttatctgaggctccagctcaaccagctgagagtgaggaaccttcagtagcagcatcttctgaggaaaccccatctccatcaactccagcggccccagaaactcctgaagaaccagcagctccatctccatcacctgagagtgaggaaccttcagtagcagctccttctgaggaaaccccatctccagaaactcctgaagaaccagcagctccatctcaaccagctgagagtgaagaatcttcagtagcagctacgacaagcccgtctccatcaactccagctgaatcagagactcagacgccaccagctgttactaaagactctgataagccatcttcagcagctgaaaaaccagcagcctcttcacttgtttcagaacaaaccgttcaacaaccaacttcaaagagatcttctgataaaaaagaagagcaagaacagtcttactctccaaatcgctcattgtcaagacaggttagggcccatgagtcaggtaagtacttgccttcaacaggtgaaaaagcacagccactctttatagctactatgactttgatgtctctatttggcagtcttttagtcacaaaacgccaaaaagaaactaaaaaa

SEQ ID NO: 775 - DNA, 3543 bp, Streptococcus pyogenes
ttgcgtaaaaaacaaaaattaccatttgataaacttgccattgcgctcatgtctacgagcatcttgctcaatgcacaatcagacattaaagcaaatactgtgacagaagacactcctgctaccgaacaagctgtagaaaccccacaaccaacagcggtttctgaggaagcaccatcatcaaaggaaaccaaaaccccacaaactcctgatgacgcagaagaaacaatagcagatgacgctaatgatctagcccctcaagctcctgctaaaactgctgatacaccagcaacctcaaaagcgactattagggatttgaacgacccttctcaggtcaaaaccctgcaggaaaaagcaggcaaaggagctgggactgttgttgcagtgattgatgctggttttgataaaaatcatgaagcgtggcgcttaacagacaaaaccaaagcacgttaccaatcaaaagaagatcttgaaaaagctaaaaaagagcacggtattacctatggcgagtgggtcaatgataaggttgcttattaccacgactatagtaaagatggtaaaaccgctgtcgatcaagagcacggcacacacgtgtcagggatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcatagatgctgtcaacttgggagctaaggtgattaatatgagctttggtaatgctgcactagcctatgccaaccttccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctacggtcaaaacagccgatcagcaagataaagaaatgcctgttctttcaacaaaccgttttgagccaaacaaggcttacgactatgcttatgctaatcgtgggatgaaagaggatgattttaaggatgtcaaaggtaagattgcccttattgaacgtggcgatattgatttcaaagataagattgcaaacgctaaaaaagctggtgctgtaggagtcttgatctatgacaatcaggacaagggcttcccgattgaattgccaaatgttgatcagatgcctgcggcctttatcagtcgaaaagatggtctcttattaaaagagaatccccaaaaaaccatcaccttcaatgcgacacctaaggtattgccaacagcaagtggcaccaaactaagccgcttctcaagctggggtctgacagctgacggcaatattaagccagatattgcagcacccggccaagatattttgtcatcagtggctaacaacaagtatgccaaactttctggaactagtatgtctgcgccattagtagcgggtatcatgggactgttgcaaaagcaatatgagacacagtatcctgatatgacaccatcagagcgtcttgatttagctaaaaaagtattgatgagctcagcaactgccttatatgatgaagatgaaaaagcttatttttctcctcgccaacaaggagcaggagcagtcgatgctaaaaaagcttcagcagcaacgatgtatgtgacagataaggataatacctcaagcaaggttcacctgaacaatgtttctgataaatttgaagtaacagtaacagttcacaacaaatctgataaacctcaagagttgtattaccaagcaactgttcaaacagataaagtagatggaaaactctttgccttggctcctaaagcattgtatgagacatcatggcaaaaaatcacaattccagccaatagcagcaaacaagtcaccattccaatcgatgttagtcaatttagcaaggacttgcttgccccaatgaaaaatggctatttcttagaaggttttgttcgtttcaaacaagatcctacaaaagaagagcttatgagtattccctatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttactacagagtctaatccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacatacacctatcgtgttcgctacactccgattagctcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggaaggccactctaataaaccagaacaagacggttcagatcaagcaccagacaaaaaaccagaaactaaaccagaacaagacggttcaggtcaagcaccagataaaaaaccagaaactaaaccagaacaagacggttcaggtcaaacaccagacaaaaaaccagaaactaaaccagaacaagacggttcaggtcaaacaccagataaaaaaccagaaactaaaccagaaaaagatagttcaggtcaaacaccaggtaaaactcctcaaaaaggtcaaccttctcgtactctagagaaacgatcttctaagcgtgctttagctacaaaagcatcaacaaaagatcagttaccaacgactaatgacaaggatacaaatcgtttacatctccttaagttagttatgaccactttcttcttgggattagtagctcatatctttaaaacaaaacgcactgaagat

SEQ ID NO: 776 - DNA, 1452 bp, Streptococcus pyogenes
atggctaaaaataacacgaatagacactattcgcttagaaaattaaaaacaggaacggcttcagtagcggtagctttgactgttttaggggcaggttttgcgaatcaaacagaggttaaggctaacggtgatggtaatcctagggaagttatagaagatcttgcagcaaacaatcccgcaatacaaaatatacgtttacgttacgaaaacaaggacttaaaagcgagattagagaatgcaatggaagttgcaggaagagattttaagagagctgaagaacttgaaaaagcaaaacaagccttagaagaccagcgtaaagatttagaaactaaattaaaagaactacaacaagactatgacttagcaaaggaatcaacaagttgggatagacaaagacttgaaaaagagttagaagagaaaaaggaagctcttgaattagcgatagaccaggcaagtcgggactaccatagagctaccgctttagaaaaagagttagaagagaaaaagaaagctcttgaattagcgatagaccaagcgagtcaggactataatagagctaacgtcttagaaaaagagttagaaacgattactagagaacaagagattaatcgtaatcttttaggcaatgcaaaacttgaacttgatcaactttcatctgaaaaagagcagctaacgatcgaaaaagcaaaacttgaggaagaaaaacaaatctcagacgcaagtcgtcaaagccttcgtcgtgacttggacgcatcacgtgaagctaagaaacaggttgaaaaagatttagcaaacttgactgctgaacttgataaggttaaagaagacaaacaaatctcagacgcaagccgtcaaggccttcgccgtgacttggacgcatcacgtgaagctaagaaacaggttgaaaaagatttagcaaacttgactgctgaacttgataaggttaaagaagaaaaacaaatctcagacgcaagccgtcaaggccttcgccgtgacttggacgcatcacgtgaagctaagaaacaagttgaaaaagctttagaagaagcaaacagcaaattagctgctcttgaaaaacttaacaaagagcttgaagaaagcaagaaattaacagaaaaagaaaaagctgaactacaagcaaaacttgaagcagaagcaaaagcactcaaagaacaattagcgaaacaagctgaagaacttgcaaaactaagagctggaaaagcatcagactcacaaacccctgatacaaaaccaggaaacaaagctgttccaggtaaaggtcaagcaccacaagcaggtacaaaacctaaccaaaacaaagcaccaatgaaggaaactaagagacagttaccatcaacaggtgaaacagctaacccattcttcacagcggcagcccttactgttatggcaacagctggagtagcagcagttgtaaaacgcaaagaagaaaac

SEQ ID NO: 777 - DNA, 1623 bp, Streptococcus pyogenes
atgaagaaaaggaaattgttagcagtaacactattaagtaccatactcttaaacagtgcagtgccattagttgttgctgatacctccttgcgtaatagcacatcatccactgatcagcctactacagcagatactgatacggatgacgagagtgaaacaccaaaaaaagacaaaaaaagcaaggaaacagcgtcgcagcacgacacccaaaaagaccataagccatcacacactcacccaacccccccttcaaatgatactaagcagaccgatcaggcatcatctgaagctactgacaaaccaaataaagacaaaaacgacaccaagcaaccagacagcagtgatcaatccaccccatctcccaaagaccagtcgtctcaaaaagagtcacaaaacaaagacggccgacctaccccatcacctgatcagcaaaaagatcagacacctgataaaacaccagaaaaatcagctgataaaacccctgaaaaaggaccagaaaaagcaactgataaaacaccagagccaaatcgtgacgctccaaaacccatccaacctcctttagcagctgctcctgtctttataccttggagagaaagtgacaaagacctgagcaagctaaaaccaagcagtcgctcatcagcggcttacgtgagacactggacaggtgactctgcctacactcacaacctgttgtcacgccgttatgggattactgctgaacagctagatggttttttgaacagtctaggtattcactatgataaagaacgcttaaacggaaagcgtttattagaatgggaaaaactaacaggactagacgttcgagctatcgtagctattgcaatggcagaaagctcactaggtactcagggagttgctaaagaaaaaggagccaatatgtttggttatggcgcctttgacttcaacccaaacaatgccaaaaaatacagcgatgaggttgctattcgtcacatggtagaagacaccatcattgccaacaaaaaccaaacctttgaaagacaagacctcaaagcaaaaaaatggtcactaggccagttggataccttgattgatggtggggtttactttacagatacaagtggcagtgggcaaagacgagcagatatcatgaccaaactagaccaatggatagatgatcatggaagcacacctgagattccagaacatctcaagataacttccgggacacaatttagcgaagtgcccgtaggttataaaagaagtcagccacaaaacgttttgacctacaagtcagagacctacagctttggccaatgcacttggtacgcctataatcgtgtcaaagagctaggttatcaagtcgacaggtacatgggtaacggtggcgactggcagcgcaagccaggttttgtgaccacccataaacctaaagtgggctatgtcgtctcatttgcaccaggccaagcaggagcagatgcaacctatggtcacgttgctgttgtagagcaaatcaaagaagatggttctatcttaatttcagagtcaaatgttatgggactaggcaccatttcctatcggacgttcacagctgagcaggctagtttgttgacctatgtcgtaggggacaaactcccaagacca

SEQ ID NO: 778 - DNA, 1266 bp, Streptococcus pyogenes
atgtttcagttaagaaaaaaaatgacgcgcaaacaattagccttgttgagtgctggagtgttgacctgtgtggttggtggtagctacttgataatgaaccatcaacaacaagaaattgtctctagtgtcaacaaagtaaaagccttaaccataaaagaagccatggaacaaggaaaagatatcagcttgaccttagctggcgaagtaacagctaacaacagcagcaaagtcaaaatcgactcaagtaaaggagaagtcaaagaggtctttgttaaaaaaggcgatgttgtcaaagtaggacaacccttgtttagctatgaaacgtcacagcggttaacggctcaaagttcagaatttgatgttcaaaccaaagccaatcagctccaagttgctaaaaccaatgcagcattgaagtgggaaacctacaatcgcaaggtcaatgaaatcaacaccctaaaatctcgctacaacactgcaccagatgagagcttactagagcaaattcgcagcgcagaagacagtgtatcccaagcactaagcgatgccaaaacagcagatagcgatgtcaaaaccgctcaaatcgaactcgataaagctaatgctactgccacaacggaaaaaggtaaactagagtatgacaccgttaagtcagacaccgcaggaaccattgttagtctaaatactgatttgccaaatcaatcaaaatccaaaaaagaaaatgaaacttttatggaaattatcgacaaatcaaaaatgttagtcaaaggtaacattagtgaatttgaccgtgacaagttaaaaatcggtcaaaaagtcgaagtgattgaccgcaaagacaactctaaaaaatggactggaaaagtaacccaagttggcaacctcaaagcagaggaaaaaggccaaggtcaaggccaaggtggcaatgaccaacaagataatccaaaccaagcaaaattcccttatgttattgaacttgaccaatcagacaagcagccactcattggctcacacacctatgttaatgtgctcaacaatgttccagaagctggcaagatcgtattgaaagaaacctttacaatggcagaaaatggaaaaacctatgtgtggaaagttgataaaaacaaggtcaaaaaacaagaaatcaagactaagcccttctcaaaaggttatgttgaggtaacaagtggcttgactatgcaagataagattgctcagccgcttcctggcatgaaagacggtatggaggtaggaagtattgttaaacct

SEQ ID NO: 779 - DNA, 813 bp, Streptococcus pyogenes
atgaatctacttggatcaagacgggttttttctaaaaaatgtcggctagtaaaattttcaatggtagctcttgtatcagccacaatggctgtaacaacagtcacacttgaaaatactgcactggcacgacaaacacaggtctcaaatgatgttgttctaaatgatggcgcaagcaagtacctaaacgaagcattagcttggacattcaatgacagtcccaactattacaaaaccttaggtactagtcagatcactccagcactctttcctaaagcaggagatattctctatagcaaattagatgagttaggaaggacgcgtactgctagaggtacattgacttatgccaatgttgaaggtagctacggtgttagacaatctttcggtaaaaatcaaaaccccgcaggctggactggaaaccctaatcatgtcaaatataaaattgaatggttaaatggtctatcttatgtcggagatttctggaatagaagtcatctcattgcagatagtctcggtggagatgcactcagagtcaatgccgttacagggacacgtacccaaaatgtaggaggtcgtgaccaaaaaggcggcatgcgctataccgaacaaagagctcaagaatggttagaagcaaatcgtgatggctatctttattatgaagctgctccaatctataacgcagacgagttgattccaagagctgtcgtggtatcaatgcaatcttctgataataccatcaacgagaaagtattagtttacaacacagctaatggctacaccattaactaccataacggtacacctactcagaaa

SEQ ID NO: 780 - DNA, 1974 bp, Streptococcus pyogenes
atgaaaaaatttcgttttgaaaccattcatttgattatgatgggattgattttatttggactgctggcactttgtgtcagtattatgcaatcaaaaatattaatattattagctatttttctcgttttgctatttgttgttgctcttttatggtatcaaaaagaagcttatcaattatcagacttagctcatattgagctcttaaatgaacaaacagaagataacctaaaaacgctacttgataatatgcctgttggagtagttcaatttgatcaagagaccaacgctgtagaatggtataatccttatgcagaattaatttttacaactgaagagggttttatacaaaacggtttgattcagcaaattattacggaaaaacgtcgtgaagatatttctcaaacatttgaagtttctggtaataaatacacttcttatattgatgtatcatcaggaattttttatttttttgatagctttgtgggaaacaggcaattagctgatgctagtatgttaagaccggttgttggcattatttcggttgataattatgatgatatcactgatgatttatcagatgcagatacctcaaaaattaattcatttgtagctaacttcattgatgagtttatggagtcaaaacggattttttaccgtcgtgttaatatggatcgctactatttctttacagactttaaaacattaaatgatttgatggataataaattttctgtcttagaagagtttcgtaaagaagctcaagatgctcagcgccctttaacactcagcataggaatttcttttggtgaagaaaatcatagccagattggacaggtagctcttgagaatcttaatattgcgcttgttcgtggtggtgatcagattgtcattcgtgaaaatgcggatcatacgaatccaatttatttcgggggagggtctgtttctacagttaaacgttcaagaacacgtacccgtgctatgatgacagctatttcagatcgaatcaagatggtggacaatgtttttattgttggacataggaaacttgatatggatgcactaggttcagctgttggtatgcaatttttcgcaggtaacattattgaaaatagttttgccgtttacaatccagatgagatgagtccagatattgaaagggctattgagcgattgcaggctgacggaaagactcgtctaatcagtgtttctcaagcaatgggtttagtgactccaagatcacttttagtaatggttgaccattctaagatatctttaacactttctaaagaattttatgaacagtttcaaaatgttattgtagttgatcatcacagaagagatgatgattttcctgataatgctatcttaacttttattgaaagtggagcaagtagtgctgcggagctcgtcactgagttaattcaatttcaaaatgctaaaaaatgtttaaataagatccaagccagtgttttaatggcaggtattatgcttgatactaaaaatttttctacgcgagtgacaagtcgtacctttgatgtcgctagttacttaagaagcaaaggaagtgatagtgttgaaattcaaaatatatccgcaacagattttgaagaatataagcaaataaatgaaattattttacaaggagaacgtcttggtgacagtatcattgtagctgcaggagaaaaaaatcatctttatagcaatgttattgctagtaaagctgcagatacgatactgtcaatggctcacgttgaggctagctttgtattagttgaaacagcttctcataagattgctatttcagctagaagtcgtagtaaaatcaatgttcaacgtgtgatggaaaaattaggtggaggaggccactttaatcttgctgcctgtcagttaacggatatcagtcttccccaagcgaagtacttattattgaaaactattaatatgacaatgaaagaaacaggagaagtagaatca

SEQ ID NO: 781 - DNA, 1221 bp, Streptococcus pyogenes
atgccaagtatgaaacatatcttaaaatccttaagtattttactaattggatttttaggaggattaatagcaattattacattcaataatctctacccacattctccatcaaaaataaattcaggtaaggcaacaactagtaatatggtttttaacaacacaaccaatactactaaagctgtcaaagctgttcaaaatgcagttgtatcagttattaattatcaagataacccttcttcatccctttctaacccttatacaaaactctttggagaagggcgttcaaaagagaataaggatgctgaattatctatttttagtgaaggatctggggtcatttatcgaaaagatggcaactccgcttacgttgttactaataaccatgttatcgacggagctaaacgaattgaaattcttatggcagacggatctaaagttgttggtgaattagttggagctgatacttattcggatttagctgttgttaagatctcttcagataagataaaaacagtagctgaatttgcagattctacaaaactaaatgttggagaagttgctattgctatcggcagcccactaggaacacaatacgctaattctgttactcaaggaatcgtctctagtttaagtcgtactgtaactttaaaaaacgagaatggtgagactgtctcaacaaatgctattcagacagatgctgctattaaccctggaaactctggtggaccactaattaatattgaggggcaagtaatcggaattaattcaagtaaaatttcttctaccccaactggtagcaacggtaatagtggtgctgttgaaggaattggttttgctatcccatctactgatgttattaaaattattaaacaactagaaactaatggtgaagttatcagacctgctcttggaatatccatggtcaatttaaatgacttatccacaaatgctcttagtcaaattaatattccaactagtgtaactggtggtattgtagtagcagaagttaaggaaggaatgccggcatctggcaaacttgctcagtacgatgtgattacagaaattgatggcaaaacagttaattcaattagtgatttacaaagtagtctatacggacacgatattaatgatactattaaagtaactttttatagaggaactacaaagaaaaaagcagatatcaaattaacaaaaactactcaagatttgactaaaacgcag

SEQ ID NO: 782 - DNA, 1248 bp, Streptococcus pyogenes
atgcttaagagactctggttaattctaggtcctcttcttattgcctttgttttagtagtgattactatttttagttttcctacacaacttgatcattccatagctcaggaaaaagcaaatgccgttgcgatcacagatagttcttttaaaaatggtttgattaaaagacaagctttatcagatgagacttgtcgttttgtgcctttttttggttctagcgaatggagtcgaatggatagtatgcacccttcggtgcttgcagagcgctacaagcggagctatagaccatttttaattggtaagagaggatcagcatctttgtcgcattattatggtatacaacaaattaccaatgaaatgcaaaagaaaaaagccatctttgtagtatctcctcaatggtttactgctcaagggattaatcctagtgcggttcagatgtacttgtctaacactcaagtgattgaatttttactaaaagctagaactgataaagaatcacagtttgcagcaaagcgtttgcttgagcttaaccctggtgtgtctaaatcaaacttattgaaaaaagtaagtaagggtaagtctcttagtcggttagacagagctattttgaaatgtcaacatcaagtagcattgagagaagagtccctttttagttttttaggcaaatctactaactatgaaaaaagaattttgcctcgcgttaagggattacctaaagtattttcgtataaacaattgaatgcattagcaactaagagaggccaattagcaacaaccaacaaccgttttgggattaaaaatacattttatcgtaaacgaatagcacctaaatacaatctttataagaatttccaagttaattatagttacctggcgtcaccagaatacaatgattttcagcttttattatcagaatttgctaaacgaaaaacagatgtactctttgttataactcctgttaataaagcttgggcggattataccggcttaaatcaagataagtatcaagcggcagttcgtaaaataaaattccagttaaagtcacaaggatttcatcgcattgctgacttctcaaaagatggtggtgagtcctactttatgcaagataccatccatctcggttggaatggctggttagcttttgataagaaagtgcaaccatttctagaaacgaagcagccagtgcccaactataaaatgaacccttatttttatagtaaaatttgggcaaataggaaagacttgcaa

SEQ ID NO: 783 - DNA, 822 bp, Streptococcus pyogenes
gtggcaaccaattcaattattgccgacatgacaaaagctattgctggtgataaaatcgatctgcacagcattgtgccaatcggtcaagaccctcatgagtacgaaccattaccagaagatgttgaaaaaacaagtaatgctgatgtgattttctataatggtatcaatctagaagatggcgggcaagcttggttcaccaaactagtgaaaaatgctcaaaaaacgaaaaacaaagattactttgccgtgtctgatggcattgatgtgatttacttggaaggtgcaagcgaaaaaggaaaagaagatccacatgcttggttaaatctcgaaaacggaatcatttattcaaaaaacattgccaaacaattgattgcaaaggatcctaaaaacaaagaaacttatgaaaagaacctaaaagcttatgtggctaaattggaaaaactagacaaagaagccaaatcaaaatttgatgctattgcagaaaataaaaaattgattgtgactagtgaaggctgcttcaagtacttttcaaaagcttacggtgtcccatctgcttatatctgggaaattaacaccgaagaagaaggaacaccagatcaaatttcatcattgattgaaaaactaaaagtcatcaagccatctgcgctttttgtagagtcaagtgtcgatagacgccctatggaaactgtttctaaagatagtggtattcctatttattctgagatctttacagattcaattgctaaaaaaggtaaacctggcgatagttattatgctatgatgaaatggaaccttgacaaaatttctgaaggtctagcaaaa

SEQ ID NO: 784 - DNA, 1305 bp, Streptococcus pyogenes
atgtcaattattactgatgtatacgctcgcgaagtccttgactcacgcggtaacccaacacttgaagtagaagtttatacagaatcaggtgcattcggacgtggtatggttccttcaggagcttcaactggtgaacatgaagccgttgaacttcgtgatggtgacaaatctcgttaccttggtctaggtactcaaaaagcagttgataacgttaataacattatcgctgaggcaatcatcggttacgatgttcgcgatcaacaagctatcgaccgtgcaatgatcgctcttgacggtactcctaacaaaggcaaacttggtgctaatgctattcttggtgtttctatcgctgttgctcgtgcagctgctgactatcttgaagtgccactttacacttaccttggcggattcaacactaaagttcttccaactcctatgatgaacatcatcaacggtggatcacactcagatgccccaattgcattccaagagttcatgatcatgccagttggtgcacctactttcaaagaaggtcttcgttggggtgctgaagttttccacgctcttaagaaaattcttaaagaacgcggacttgttacagctgtaggtgacgaaggtggatttgctcctaaatttgaaggaactgaagacggtgtagaaactatccttaaagctattgaagcagctggttacgaagctggtgaaaacggcattatgatcggttttgactgtgcatcatcagaattctacgacaaagaacgtaaagtttacgactatactaaatttgaaggtgaaggcgctgctgttcgtacatctgcagaacaagttgattaccttgaagagttggttaacaaatacccaattattactatcgaagatggtatggatgaaaacgactgggatggttggaaagttcttactgaacgcctaggcaaacgtgttcaattggttggtgacgacttcttcgttacaaacactgaataccttgctcgtggtatcaaagaaaatgcagctaactcaatccttatcaaagttaaccaaatcggtactttgactgaaacgtttgaagctatcgaaatggctaaagaagctggatatactgccgttgtatcacaccgttcaggtgaaactgaagattcaacaatcgctgacatcgcagttgcaacaaacgctggccaaatcaaaacaggttcattgtcacgtacagaccgtattgctaaatacaaccaattacttcgtatcgaagatcaacttggtgaagttgctcaatacaaaggtatcaaatcattctataacttaaaaaaa

SEQ ID NO: 785 - DNA, 597 bp, Streptococcus pyogenes
ttgaaggtgaaaaaaaggagaagaagggctaaatcatcagtaaatcgacttgtcttagggttagtattacttaatctgattgttagtatgtggacactaaaattgggaaaccagcgattagctccgtatgcggatcacgaaactctgacatttgtcaggaagattagtcatgctgctcaatcagtcgctcaaaagaaacagttatatagttcggtgatgatggctcaggccattttagaatccaataatggtaagtcacaactaagtcaaaaaccttattataattttttcgggattaaggggagctataaagaacggtcagtcatttttccaactttagaagacgatggacaagggaatctttatcaaattgatgctgcttttcgttcctatgggagcctgacagcttgttttttagattacgcaagagttttgaatgatccactttatgacaaaacccacaaaaagttttggtctcattatcaagatgctactgcaaccttaacaggcacttacgccactgatacaacttaccataccaaattaaatgaattgattgaatggtatcaactcactaattttgatggtctaatgaaa

SEQ ID NO: 786 - DNA, 705 bp, Streptococcus pyogenes
atgacaaaaaagaaaggtaagcttgtacttatcagtctttttgttctagcagcttgtttaggagcttatagtgcaatgagacaatctcataaaacttcaaacgtgtcagctgagactatcgccagttcttcaacccgacattttattgatgaaattggtccaactgctagtactattggtcaagaacgtgatctttatgcgtctgttatgatagcacaagcgattttagaatcaagtaatggtaaatcaagtctaagtcaagcaccttattataattttttcggtattaagggtgcctataacggttcttctgtgacgatgtcaacttgggaagatgatggtaatggcaatacctatacgattgatcaagcctttagagcttatccaagtattgcagactcccttaatgactacgcggacttgctaagttctagcacttatataggtgctagaaaatcaaacacgctatcgtatcaagatgctacagcagctctaactggcttatacgctacagacaccagttataacttaaaactaaataatattattgcaacctatggtttgacggcttatgatgttgctaatagctcagctcaagaaactggtctagcaacttcgggttatgtttggaatgaatatcgtcgtaattacactgatgcggagaccctagcagttgatgaggcttgggctaaacgcatgacttat

SEQ ID NO: 787 - DNA, 2010 bp, Streptococcus pyogenes
atgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcc

SEQ ID NO: 788 - DNA, 762 bp, Streptococcus pyogenes
atggcacaaagaatcattgttatcacgggagcttctggaggactggctcaggcaattgttaagcagttacccaaggaagacagcttgattttattaggacgtaacaaagaacgcctagaacactgttatcagcatattgacaacaaagaatgcctcgagttggatattaccaatccagtagccattgagaaaatggtcgcccagatttaccagcgctatggccgtattgatgtcttgattaataatgctggctacggagctttcaaaggctttgaagagttttctgcccaagaaatagctgatatgtttcaggttaacaccctagcgagcattcactttgcttgcttgattggtcagaaaatggcagagcaggggcaaggtcaccttattaatattgtgtccatggcaggcttgattgcgtcagccaaatcgagcatttattcagccaccaagtttgcccttatcggattttccaatgcccttcgcttagaattagcggataaaggggtttacgtgaccaccgtgaatccaggtcccattgccaccaagttttttgaccaagctgacccgtctggacattatttggaaagcgttggtaaatttactctccaaccaaatcaagtggctaagcgtttggtttctattatcgggaaaaataaacgagaattgaatttgccctttagtttagcggtgacccatcaattttacacccttttccctaaattatctgattatcttgcaagaaaggtatttaattataaa

SEQ ID NO: 789 - DNA, 1332 bp, Streptococcus pyogenes
atggctacatatcaggaatataaaagtcgttcaaatggcaatgcttacgatattgatggatcgcttggtgcgcaatgttgggatggctacgcagactactgtaagtatctaggactgccatacgcaaactgtacaaatacaggatatgcaaaggatatatgggaacaacgtcacaaaaatggtattttaaactactttgacgaagtagagactatgcaagctggagatgtcgcaatttttatggtagttgcaggtgttacaccgtatagccatgtggctatttttgatagtgatgcaggtagtggatacggatggtttttaggtcaaaaccagggtggagcaaacggagcatataatttagtaaaaataccatattcaacgacttatcctactgcatttagaccaaaagtttttaaaaatgcagttactgttataggtaatataggactaaataaaggcgattattttattgatgtatcagcttatcaacaagcagacttaaccgctacttgtcagcaagctggcactactaaaacgattatcaaagtatccgagtcactcgcttggctgtctgataggcatcagcaacaagctaatactagtgaccctattggttattatcactttggacgatttggaggagatagcaacttagcgcaacgagaagcagatttatttctgtccaatttaccaaccaaaaaagtctcttacttagtcattgattatgaagactctgcaagtgccgacaaagaagctaacactaatgcagttattgcgtttatggataaaattgcaaacgctggatataagcctgtttattacagctataaaccatttacgcttaataatattgattatcagcaaattatcgctaagtacccaaacagcatttggatagctggttatccagactacgaagtacgaacagagccactttgggagttcttcccttcaatggatggtgtgcgctggtggcagttcacaagtgtaggagtagcaggtggtttagataaaaatattgtattattagcagatgatagtagcaaagtggatatacctaagattgacaaaccacaaagccagcttacttttaatcaaaagctagatactaacactaaattagacaactcgaatgtaccttactacgaagcaacccttagaacagactattatgtagagtctaagccaaacgcaagtagcgctgataaagaatttatcaaggcaggaactcgtgtaagagtctatgaaaaagtgaatggatggtcacgtattaacgcttctcagtctgaccagtgggtcgaagataagtatttatctaatgcaacacaagta

SEQ ID NO: 790 - DNA, 777 bp, Streptococcus pyogenes
gtgagaaaaattgtaaatgttaattttaaaaagtttttaacttcatcttttctattgtgggtatttatatcagctataattccaacgtgttacgcgtatgagatgagtagtgtgggagttattaatttaaggaatttatactctacatatgatccaacagaagtaaaaggaaaaataaatgaaggtccgccattttcaggtagtttgttctacaaaaatattccttatggcaatagttcgattgaattaaaagtagaacttaatagcgtagaaaaagctaattttttttctggtaaaagggtggatatatttactttggagtattctcctccctgtaactctaatataaaaaagaattcatatggaggtattactttaagcgacggtaatagaattgataaaaaaaatatacctgttaatattttcatagacggcgttcaacaaaaatatagctatacagatataagtacagggagtactgataagaaagaggttacgattcaggaacttgatgtgaaatcaagatattatcttcaaaaacattttaatatatacggattcggtgatgttaaagattttggccgctcctctagatttcaatctggctttgaggaaggaaatattatttttcatttgaatagtggagagagaatttcttataatctttttgatacaggacatggtgacagagagagtatgctaaaaaaatacagtgataataagaccgcttattctgatcaacttcatattgatatatacttagttaaatttaataaa

SEQ ID NO: 791 - DNA, 1650 bp, Streptococcus pyogenes
atgtcttttgacggctttttcttacaccatttaaccaacgaattaaaagagaacttgctttacggtcgtatccaaaaggtcaatcaaccctttgaacgggaacttgtcttaaccattcgtaaccatcgcaagaattataaattgctattgtctgcccatcctgtttttggaagggtacaaatcacccaagcagactttcaaaatcctcaggtacctaatacctttaccatgattatgcgtaaatacctccagggtgcagtcattgagcagttagaacagattgataatgaccgcattatcgaaatcaaggtatctaataaaaatgaaatcggagatgctattcaggcaaccctaatcattgaaatcatggggaagcacagtaatatcatcttggtggaccgtgcagaaaataaaatcatcgaatccattaaacatgttggtttttcacaaaactcttaccgcaccattttacctggctctacctacattgagcctcctaaaacagctgctgttaatccttttacaattacagatgtgcctctatttgaaatcctccaaacacaagaactaacagttaaaagcttgcaacagcattttcaaggtttggggcgagacaccgcaaaagagttggccgagcttctgaccacagacaaattaaaacggttccgtgagttttttgctagacctactcaggcaaatctgaccacagcttcttttgcgcctgttcttttctcagatagtcatgcgacgtttgagactttgtctgacatgcttgaccacttttatcaagacaaggctgagcgtgaccgtatcaatcagcaagccagtgatttgatccaccgtgtgcaaactgaactggacaaaaatcgcaacaagctaagtaagcaagaagctgagctgctagccactgaaaatgctgagttgttccgtcaaaaaggagaattattgaccacctacctcagtctggtcccaaacaaccaagactctgtgattttagacaattattatacaggggaaaaaattgagattgccttagacaaggctctgacaccaaatcaaaatgctcaacgttattttaaaaaataccaaaagctaaaagaagctgtcaaacacttatctggattgattgccgataccaagcaaagtattacttactttgagagcgtagactacaatttatctcaagcaagtatcgacgacatcgaagatattcgcgaagaattatatcaggctggctttttgaaaagtcgccaaagagacaaacgccataaacgtaaaaagcctgagcagtacctggcttcagatggaacaaccattctcatggtgggacgcaataacttgcaaaatgaagaactcacctttaaaatggctaaaaaaggagaactctggttccatgctaaggatatccctggaagtcatgtcatcatcaaagacaatcttgacccaagtgacgaggttaaaactgatgctgccgaactagctgcttattattcgaaagctaggttatcaaatctcgttcaggtcgatatgattgaagctaaaaaattacacaaacctagtggcgccaagccaggatttgtgacttatactggtcaaaaaactttacgggttactcctgaccaagccaaaattctctctatgaaattatcc

SEQ ID NO: 792 - DNA, 630 bp, Streptococcus pyogenes
atggtagaaaacactaaattactatgtagctgggtatggttattagcgttagctattctcataacgatctattcaacgtggctgtggtatcctcttgaggtggaccatctaaagttagaacaagttgtttttatgagcaaggatgctatcttgcataactataacggactactcaattacctcaccaatccttttgtgacaaggttggaatttgctaattttcactcatcggcagacggactcaagcattttgcagatgtgaagtggctttttcacctaactcaagtcgtttttcttggccttctttacccaacccttaagactttcacacaaaggttaaaaaccaaacgtttctggctccttcaaaaacctttaatactagcagctttgtttcctcttatgattggtctaatggctagtttcattgggtttgaacatttttttactctttttcatcaggtgctttttgtaggagatagcagctggctctttgatcccttgaaagattctgtgatttggatccttccagaagtctttttcttgcactgtttccttttctttatgatagtttacgaaatcatcctgtggagcttagtaggtttagcaagatggcagcgcctaaatgtagaa

SEQ ID NO: 793 - DNA, 825 bp, Streptococcus pyogenes
atgaattatacaggtaaggtaaaacgagttgctattattgcaaatggtaagtaccaaagtaaacgcgtcgcctccaaacttttctccgtatttaaagatgatcctgatttctatctttcaaagaaaaatccggatattgtgatttctattggcggagatgggatgctcttatctgcctttcacatgtatgaaaaagaattagataaggtacgttttgtaggaatccacaccggtcatcttggcttttataccgattatagggattttgaagttgataaattaattgataatttaagaaaagacaagggagaacaaatctcttatccgattttaaaagttgctattactttagatgatggtcgtgtggttaaagcgcgtgctttgaatgaagcgacggttaagcgtattgaaaaaacgatggtagcagatgttattattaaccatgtcaaatttgaaagcttccgaggtgatgggatttcagtatcgaccccgacagggagcacagcctacaataaatctttaggtggtgctgtcttgcatccgacgattgaagcgctgcaattgacggaaatttccagtcttaataaccgtgtctttagaaccttgggctcatcaatcattattcccaaaaaagataagattgagttagtgccaaaacgattaggaatttataccatttccattgataataaaacctatcagttaaaaaatgtgacgaaggtggagtattttatcgacgatgagaaaattcattttgtttcctctccgagtcatacgagcttttgggaaagggtcaaggatgcctttattggagagattgactca

SEQ ID NO: 794 - DNA, 1257 bp, Streptococcus pyogenes
atgtcatggaattggaaaaaaacatctgtgcttggaactttatccttagcttcagtgctacccctaactgcttgcgtaagtggtggtggtaaaggcgttaaggaaacagacggaaagactattgtagtctctgttgatgagggatatgttgattacattaagagtattaagggtgagtttgaaaaagaacataaagtcaccgttaaagtcaaaaaagaaggtatgatggatactcttgataagctatcaacggatggtccaacaggagcttcaccagatgtctttttagcaccttttgaccgtgtaggtggtttaggaactgaaggtcaaatcgctgaggttactttaggaaacagcaaagagtttgatgatacggttaagaaattagtaaccattgatggtaaaacttatggtgcaccagacgtaattgaaactttggtaacttattataataaggatttagtgcctcaagcacctaaaagctttactgaattagaagtcttacaaaaagattctaagtttgcttttgcctctgaaccaggaaaatctgtaggtttcttggcgaaatggacagacttctattatggttatggtttaattgccggttatggcggttatatctttggtgataaaggaaccaaaccaagtgatttaggcctaggtaacgacggaactgttgaagggttaaactacgcgaaacagtggtatggcacttggcctcaaggaatgcaagacactaaaaaagctggtgattttatcactgaacaatttatttctaaaaaagctggtgtcattattgatggtccatgggcagctagctcctttaaagatgctggtgttaactttggggtaatggaaattcctactttgacaaatggtaaaaaataccaaccgttcgcaggtggtaaagcttgggttatttcaaactattctaaaggaaaaacgactgctcaaaaattccttgattatgtgaccaatgctgaaaaccaaaaacgtttctatgataaaacacaagaaattccagctaacttaacagcacgtaactatgcttctaaagagggtaatgagttaacgaaagctgtgattagtcagtttgagagcgcacaaccaatgccaaatattccagaaatggctgaagtttgggaaccaggtgcaaatatgttctttaacgtggcttctggtaaggaagaagcatctaaagctgcaaaagaagcagcaaaaactattaaggaagctattgaacaaaaatacgctgaa

SEQ ID NO: 795 - DNA, 825 bp, Streptococcus pyogenes
atgcctaaagaaagagtagatgtgttagcctataagcaaggattatttgagaccagagagcaagctaagcgtggtgtcatggcaggcttagtggtctctgtgattaatggccaacgctatgacaagccaggtgacaaaattgacgatgggactgagttaaaacttaaaggtgaaaaactcaaatacgtcagtcgtggtggattaaaactggaaaaggggctgcacgtttttggtgtatcagttgctaatcaaattgggattgatattggcgcttcaacaggtggttttaccgatgttatgttacaagatggggccaaactagtctatgccgtcgacgttgggactaaccagttggtatggaaactcagacaagatccacgagtaagaagtatggaacagtataactttcgttatgctcagccagaagactttaatgagggacagcctgtatttgccagtattgatgtgtcctttatttctctcagcttgattttgccagccctgcataacgttttgtcagatcagggacaggttattgctctcattaaaccgcaatttgaagctgggcgcgagcagattggtaaaaaaggcatcgtcaaggacaaacagattcatgaaaaagtgattcaaaaggtcatggattttgcctcaggttacggatttacagttaagggacttgatttttctcctattcagggtggtcatggcaatatcgaatttttagctcatcttgctaagtcacagacacctgaaacgttagccccgcatttgattcagaaagttgttgccaaggcacataaggagtttgagaaacatgaaaaagag

SEQ ID NO: 796 - DNA, 1317 bp, Streptococcus pyogenes
atggcattttcatttgatactgcatcaattcaaggtgcaattataaaagtaattggagtcggcggaggtggcggaaatgccattaatcgtatgattgatgaaggtgttgctggtgtcgagttcatcgcagcaaacacagacattcaggcattaagctcatcaaaagctgaaacggttattcaactaggccctaaattaactcgtggacttggtgctggaggacaacctgaagtaggacgtaaagctgctgaagaaagcgaagaaattttaacagaagctcttacaggagcggacatggtatttattactgccggtatgggtggtggctctgggacaggggctgcaccggttattgctcgtatcgctaaaagtttgggagccttgacagtagctgttgttactcgcccgtttggttttgaaggtaacaaacgtggtaattttgctattgaaggtatcgaagaactacgtgaacaagttgatactttgttaattatttcaaataataaccttcttgagattgttgataaaaagacacctttattagaagcacttagtgaagctgataatgttttacgccagggagttcaagggataaccgacttaattactagtcctggccttatcaatctcgattttgccgacgtgaaaacagttatggcaaataaagggaatgccttgatggggattgggattggctctggagaagagcgcattgttgaggcggcgcgtaaggcaatctattcacccctattagaaacgactattgatggtgcacaagacgttattgtgaacgttacaggaggtctcgacatgacacttacagaagctgaagaagcctctgaaattgttgggcaagctgctggtcaaggcgttaacatttggttaggaacatctattgatgatactatgaaagatgacatccgtgtgactgttgtagcaactggagtgcgccaagaaaaagccgaacaagtttcaggttttcgtcagcctaggacttttacccaaaccaacgcgcagcaagtagcgggtgcacaatatgcatcagatcaagcaaaacagtcggttcaaccagggtttgatcgtcgctcaaattttgattttgacatgggggagtctcgcgagataccaagtgcacaaaaggtaatttctaatcataatcaaaatcaaggttctgcttttggaaattgggatttgagacgtgataatatttctcgtccaacagaaggtgaattggataaccatcttaatatgtcaacgttctcagctaacgatgacagtgatgatgaattagaaacgcctccattctttaaaaaccgt

SEQ ID NO: 797 - DNA, 1080 bp, Streptococcus pyogenes
atgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 798 - DNA, 2820 bp, Streptococcus pyogenes
atggtttatcgccaaaagagttcagagatcgttacaaggacaattaccaagccatcaagggcgaccagtaacgtcaaacaggagattgatatgacaccagatagcaaggagcagacagtgactggctaccaataccactatattgatcaagaaggaagaaagcagccctttaatcaaggctggcgttttcttatggcagatgtggcgtgtgctcaggacccttcttttgatgattcgaactggcaggtgattcatttaccacatgatttcagtcttacgcagccttacacaagaaatggtgaagctgaaagtgcttataaattaggtggtgtcggttggtatcggcattatctcgtgttagatgaggttttagctggttgtcatgttgccattacttttgagggttcctatatggaaacggaaatttatgttaacgggcaattcattggcaaacacttaaatggctatcaggaatttacttatgatatctctgatgttgtgacttttggagctgaaaatcttctggctgtccgggttgaaaacaaggttcccagttctcgttggtattcaggcagtggtctttatcgtgaagtgagtttgtctgttcttccccagcttcattttgtggcagaccaggtagcaatgaccttggctgatactgctgtgcaggagaaagggcaacagaaagttgatttacgctttgccctcaatcagtctattcagacttgccactaccaattgagcctctgtttatgggaacaatcacattgctcaaaagacaagaaactcctttatcaagaaacagaagtgcctctagctgatttggctttccaaagacagtatggtcttacactgtctttggaagaactccaattgtggtcaccagataatcctcacctctacgatttagaactcactctttactatcaaggtcaggtcattgattgcttttgccttgaaactggttttcgtcagctgacttttatggccaatcaggggctttttgtgaatggcagagctgtcaaattaaagggagtttgtttgcatcatgaccaaggaggcctaggagcttgtgcttacgaagatgccctagccagacaattagtcctgttgaaagacatgggggctaataccattcgtagcacccataacccaagtagtcccaaacttaggcaactagccaatcgtctcggcttttttgtgattgaagaagcctttgacacctggacctatgccaaaaatggaaacgttaatgacttttcaaactatttccatcagactatcggaactgaaaatgcaaactatcttcaaagagtgaggtcacctgaaacgagctgggcccagtatagtattgaggccatggtctggtctgccaagaatgacccgtcagtgttgatgtggtcgattggtaatgaattgatggagggtttttcagccgatgtcagtcattacccagagctgacaagacaaatgtgccaatggattactgctattgacacctcacgtcccattacctttggggacaataaattaaaagaagctgacttttgctggcatgaggaagtgtcgcaaatggcaactcttcttagtcaattagaccatcctcagggactcattgggttaaactatgctgatggaaaagactatgataggcttcatgaggagcactctgattggctgttgtatggttctgaaacagtctcagccattaccagcagggcttattataaagagacaaaaaaagttcttgactccggttatcacctaacctcttatgatcatgctaaggttgattggggtgccttcgctagccaggcttggtatgataccattacccgtgattttgttgctggcgaatgcgtttggacaggctttgattatttaggagaacctaccccctggaacaagatcgacagcggtgttgtaggcctttggccttctcctaaaaatgcctactttggcattttagacacggcaggctttccaaaagatagctattatttttaccaaagtcagtgggcgcaggggcagaccaccttgcacctgttaccagtctggcagaaggaccagctttgtttcgatgagcagggattggtggaggttgtggtttatagcaatgctgccagtgtgcaactgatgtttgaagatgagcagggcaacttaacagattatggaaggaaggcatttcatacttatagcacgccaacgggacacacttatcagctttaccaaggagctgacgctgctaagaatcctcacgagaacctttacctgacttggcgagtgccctatcaaaaagggttgctaagggcagtggcctacgacatttctggtaaaagcattccaaaaaccagtggacgttctcaggttagaacctatggttcagtggcaaagctatcttggaaagcctttgaagcacctattgacgctccttgggaattgctttatctggatttatcactcttggatagccgaggtgaattggtcagccatgctcaagattggttgcaggttcaagtagaaggaccagcccgtttgttggctcttgataatgggaatccgactgaccacaccccttatcaggagcctctgcgccaggcatatgggggaaaattattagccattttagccctcactggagaggcgggacacattaaggtcacggcaaaagcctcgcagcaacttagcagtgtttttcagacacaagtagcctgccgtgcccccaaagaacacttagtgacactacctttagagaaatatcagtttaaaaagagccgactgacaagtcaacaagaaattggtcaatcttgtctaaagacc

SEQ ID NO: 799 - DNA, 1467 bp, Streptococcus pyogenes
gtgtcagaagaaagcaaagaagtcgaagtaacaaaagaatcgcaaacattggggcttaatgaagccaagtcaatgacaattggtgaagctgtacgcaaacagtcagagataaaagcaggtgttactaaggatgatagtattttagataagtacattaagcaacaccgtgacgaagtttcttctcaaaagtttgatgctaagtatacagagcttgatacagctagtttagataactttatcaaaaaacaaagagaagcattgagtaaagccggtcttgttgatgacgaacctgtgtctgcggagtctgctgagcaagatagcactttggttgaagaagtagctgaagacttagctccaatggagactactgcggtggtaactgggattccggtggaagcgacagtccctgtgttagatctagatccatcagagagggtcattccagaaccacagatgaccaaggaagaaccaaaaagagatcagtttctttctgaagatagccaccatccagccaaacaaaacacgaaaaaaggttggttaatagctttatttctgctattattggccattcttgcagttgtatttggttggaaccatttcttgagacaagacagtggtaaaacaactcaaacagcaagtaaacagacaaagacctctttgcagaccgacagtgctaaaaaagcaacgcgcttgaaggctgctgctaaagctttcgaaaaactatatggtactttttatacagatgccacaaagagcaaattaaaaaatagtgcctttgctactttgccagatttagaagctgccttgaaagctttggaaggctctgcttactatgataaggcgaaagcaaaagtcgattcccttaagaaagctattgctgctattacagcggttaacggtaaatttgtttccgatgttgttgtagatggtgaaaaggtttcggctgaagtcaaggctgatgctaattttgatgatttatcaagtgcaaccttgacaataggaaatgcaaatcttgatgctgtcttgcaggcaagcatcacagaaggtcgtcagcaactagccagcaaggctgaggccgctaaagcagctaatgagcaagcagtccaggatcaagcagctcaaggacaaagtacatcagtagcaccatctggctatggcttgacaagttatgatcctgcaagcttacaacggcatttatcacgtgtaccttacaatcaagatgttattgctgacagagctaacccatcttgggcatttaatccaggagttcttgaaaaaattgtagcaacctcacaagctagaggttatatttcaggcaaccaatatattttagagccggttaatattattaatggcaatggttactataatatgtttaagcctgatggcacttatctgttctctattaattgtaagacgggttattttgtaggaaatggcaaaggttatgctgatgctttagattac

SEQ ID NO: 800 - DNA, 684 bp, Streptococcus pyogenes
acacaattcctttctgttttggagaacaaagacacccagcaaaaagcaggtaaggctagcacacctcacattcttatcactagttaccagcactatttatctctgcccttgcaggtttgttctcaggcatttgattttaaaaaaggcgacgatatcttcttgcctcagtggctccaagtcaaagatgcccaaggttctcttgtgaaaaaagctttttcaatgacgtggtacctaaaagagaaaatctttgccaagcctattcttgtcacaggctatgtttcttgttttgggcaatcaataccggttgaggcaaggcttaacctagcacaagctagcaaaagacggcaccaggatctcagtttagtcgccaagcaatccctggccgcaagtcaaaaaaggctaacttattgctaccaatatgatacggtgcaagccataggagccattagcttgcaaaatcacacaggcacatctcttagtgtttctgtggcaatcagttatggtagtcagagctctattaagcaagaaaccttgatgctagctgatagccacttgagccagttagaagaggttattttcttcgatgatattttgactgttttgtatctggcagtgacccttgaagtcattgaaggacctgacctaactgaagacagtattcaaattggcctttgggatttagca

SEQ ID NO: 801 - DNA, 3720 bp, Streptococcus pyogenes
gtgacaacagtagctttaactcaggataatcgacttttagttgaagagataggcccttacgctagtcaatcagctggaaaagagtattataaacatattgaaaagattattgttgataatgatgtctatgaaaaaagcctggagggcgagcgaacctttgatattaactaccaagggattaagatcaatgctgaccttattaaagacggtaagcatgaattgactattgttaataaaaaagatggtgatatcctaattacctttattaaaaagggcgataaagtgacctttatttcagctcaaaaattaggaacaacagatcatcaggattcattaaaaaaagatgtgctcagtgataaaacagtgccacaaaaccaaggcacacaaaaagttgttaaatctgggaaaaatactgctaacttgtcattaataacaaaattgagtcaagaagatggtgcaattttatttccagaaattgatcgttattctgataacaaacagataaaagcattgactcagcaaatcacaaaggttacagtcaatggtacagtttataaagatcttatttcagattctgtaaaagatactaatggctgggtctcgaatatgacagggcttcatcttggaacaaaagctttcaaagatggagaaaatacaatcgtgatatcctcaaaaggatttgaagacgttactattaccgttaccaagaaagatggtcaaatccattttgtatctgccaaacaaaaacaacatgtgactgctgaagacagacaatcaacaaagttggatgtcaccactttggaaaaagctatcaaagaagcggatgcgattattgctaaagaaagcaacaaagacgcggtcaaagatctggctgagaaacttcaagtcatcaaggattcttacaaagaaatcaaagatagtaagctactcgccgatactcatcgactgttaaaagataccatcgagtcttatcaagcaggtgaggtttctattaacaatctcacagaaggaacctatacgctaaactttaaagctaataaagaaaactcagaagagtcctccatgcttcaaggtgcttttgataaaagagccaaattagtggttaaagcagatggtacaatggaaatttccatgcttaatactgctttgggacaatttttgattgacttttctattgaaagcaaagggacctacccagcagcagtgcgtaaacaagttggccaaaaagatatcaatggtagctatattcgaagcgaatttaccatgcctattgatgatttggataaattacacaaaggtgctgttttggtatcagccatgggaggtcaagaaagtgatttaaaccactatgacaaatacaccaaacttgacatgacctttagtaagaccgttaccaaaggctggagtggttatcaggtagaaactgatgataaagaaaaaggggttgggactgaacgtcttgaaaaagttttagttaaacttggcaaagatttagacggcgatggtaaattatcaaaaacggaattagaacagattcgaggcgagttgcgtctagaccattacgagttaactgatatttctttattgaaacatgctaaaaatattacagaactacatctggatggaaaccaaattacggaaattccaaaagagttatttagtcaaatgaagcaacttcgatttcttaacttaagaagtaatcatttaacttatctagacaaagatacatttaaaagcaatgctcaattaagagaactctacttatcaagtaactttattcactctcttgaaggaggactattccagtcgcttcatcacctggagcaacttgatctttccaagaatcgtattggccgactttgtgataacccatttgaaggattgtctcgtctgacttcattaggtttcgcagaaaatagtcttgaggagatacctgaaaaagcgctagagcctctaacatcacttaattttatcgacttatctcaaaataatttagcactactgccaaaaacaatagaaaaattgcgcgccttaagcactattgtggcaagtagaaatcatattactcgtattgataatatttcatttaaaaatcttcctaaattatctgtactcgatttatcaactaatgaaatttcaaatcttccaaatggtatatttaaacagaataaccaattaacaaaacttgattttttcaataacttgcttactcaggttgaagaatcagtatttccagatgttgaaacgcttaatttagatgtgaagttcaatcagataaaaagtgtgagtccaaaagtaagagctcttatcggacaacacaaactgactccacaaaaacatattgcaaaacttgaagcttccttagatggcgaaaaaataaaatatcatcaagctttcagtcttttagatttgtattattgggagcaaaaaacaaattctgccattgataaagaactagtgtctgttgaagaatatcaacaattgttacaagaaaaaggttcagatacggtttctttacttaatgatatgcaagtcgattggagtattgtgattcagttgcaaaaaaaagcttccaatggacagtatgtgacggttgacgaaaagcttctctcaaatgatccgaaagatgacttaacgggagagttttctttaaaagatccaggtacatatcggattcgcaaagctttaataacaaagaaatttgctactcaaaaagaacatatctatttgacatctaatgatatccttgtggcgaaaggaccacattcacatcagaaagatttagttgagaacggccttagagcattaaatcaaaaacaattgcgtgatggtatttactatttaaatgccagcatgttaaaaactgacttagcatctgagtccatgtcaaacaaggctattaatcatcgagtgactttggtagttaaaaaaggtgtttcctatttagaagttgagtttagaggtataaaggttggtaaaatgttaggctaccttggtgaattgagctatttcgtagatggttaccaaagagatttagctggtaaaccagttggtcgaacaaaaaaggcagaggttgtgtcttatttcacggatgtaactggcctaccattggcagatcgttatggaaaaaactatccaaaagtgctgcgtatgaaattgattgaacaagcgaagaaagacggacttgtgccattacaggtctttgtgcctatcatggatgccatttcaaaagggtctggccttcaaaccgtttttatgcgtttagactgggcaagccttacaacagagaaggcaaaggttgtcaaagaaactaataatccacaagaaaatagccatctaacttcaacagatcagttgaaaggacctcaaaatcgtcaacaagaaaaaacacctacaagtcctccttcagcagctactggtattgctaacttaactgatctcctggctaaaaaagcaaccggccaatcaactcaagaaacttctaagacagatgatactgataaggcagagaaattgaagcagttagtgcgtgaccatcaaacatcaattgaaggtaaaacagcaaaagatactaagactaaaaaatctgataagaaacatcgttccaatcaacaatcaaatggtgaagaaagtagctctcgttatcacttaattgcaggtctatctagctttatgatcgtagctctgggattcattattggtcgaaagacattatttaaa

SEQ ID NO: 802 - DNA, 948 bp, Streptococcus pyogenes
atggtttacgaaatgactttggcggtcattaaatgtattgaaaaccatcttcacaaaaaagtatacaaaggggccagtctggctctctttcaatctggtcgatggcaagaataccatatcggaacaattgatggaagacgaccagttgatgctaacttagtttatgacttggctagtgtttcaaaagttgttggtgtggccacaatatgcaatattttattgaataatggtacgttagcattagatgatcccttaaaggtatattatcctagtattgctgatgcgactgtcactattcgacagttattgactcataccagtggtcttgatccttatattcctaacagagatgttttaaatgcacaacaattaagaaaagcacttaatcatcttactcaaaaagaaaataaaaacttttattacacagatgtcaatttcctcttgttaggcttcatgttagaagagctctttagtgaatctttagaccagatatttgacaagactatctttactccctttgggatgtatcatacgtcttttggccctcgtccagaagctgtaccaacattaaagggtgtgagtgatggagaagttcatgatcccaaagcaaaaatcttaaaaaaacattctggatctgcggggctattttcaactcttgcagatttagaaagttttagcaatcattatcttaatgatccattttcagattgtctgtggcgcaactacagccaacaaacaattgagcggtcactagggtggaatttagatggcgattggattagtcatacaggttacacagggccgtttctaatgcttaataaaaaagagcaaacggcagctatttttttgaccaaccgtacttacgacgaggatgataaaagtaaatggttaaaagaacgtcagttgctttacaatgcactaaagcatgatctgacaacccccgtatcg

SEQ ID NO: 803 - DNA, 795 bp, Streptococcus pyogenes
atgacaactatgcaaaaaacaattagcttattatcactagctttacttattggtttgctggggacttctggcaaagccatatctgtgtatgcacaagatcagcacactgataatgttatagctgaatcaactattagtcaggtcagtgttgaagccagtatgcgtggaacagaaccttatattgatgctacagtcaccacagatcaacctgtcagacaaccaactcaggcaacgataacacttaaagacgctagtgataatactattaatagttgggtatatactatggcagcgcaacagcgtcgttttacagcttggtttgatttaactggacaaaagagtggtgactatcatgtaactgtcaccgttcatactcaagaaaaggcagtaactggtcaatcaggaactgttcattttgatcaaaacaaagctagaaaaacaccaactaatatgcaacaaaaggatacttctaaagcaatgacgaattcagtcgatgtagacacaaaagctcaaacaaatcaatcagctaaccaagaaatagattctacttcaaatcctttcagatcagctactaatcatcgatcaacttccttaaagcgatctactaaaaatgagaaacttacaccaactgctagtaatagccaaaaaaacggtagcaacaagacaaaaatgctagtggacaaagaggaagtaaaacctacttcaaaaagaggattcccttgggtcttattaggtctagtagtcagtttagctgcaggtttatttatagctattcaaaaagtatctagacgaaaa

SEQ ID NO: 804 - DNA, 402 bp, Streptococcus pyogenes
atgacaggacaaaaaaagctagccaatctcaaaaaaacagataaaaaacagataatcgttagaaaaacagtagatgcgtctgttaaactaaaggtatcaaaacaaaaggagcatttcatcatgaaattcaaaaaagtattagtcattcctgcattagcattagcagcaacatgctttttaacagcttgtggcacaaaaaaagattctaaaaaagaagaagttaaagaaatcaaaatgtctgacatcaaagacgacgcagttagcaaaaaaacaaaagtggttgatggcgaagaagttacagaatacaccacaaaagatggaaacgtgattcagattcctgcaggaaacgaagaaggcatggaatcaaaagatgctggtggatcaggcgctcctgctaaaaac

SEQ ID NO: 805 - DNA, 2334 bp, Streptococcus pyogenes
atgagatttctagaacttttacaaaagaaattttttcctaaagcatatcaggaaaaacaattcttaatgcatcaaaaaacgcgtttaacgccacaacacaatcaaaagcagtattcgccaaatgccaatcatttggactcatcagctaccaaaaactcagaacaagaccctgcaacagctctgcaacgcagtagagcctacgaaggaagccctaaaagtcggcccgcttggttgcaaaagctggaagctgttttgccgtctcctcaacgtccaattcggcgtttttggcgccgctatcacatcggaaaactgctaatgattctgattggaactcttgtcttactcttaggatcatacttgttttacttatcaaaaacagctaaagtatctgatttacaagatgccttgaaggctacaacggttatttatgatcacaaaggagagtatgcaggcagtttatctggtcaaaaagggagttatgttgagctcaacgctatttcagatgatcttgagaatgctgttattgccactgaggataggactttttacagtaatagcggtattaatcttaaacgcttcttattggcggtagttacggcgggccgctttggaggtggctcaacgattacacagcaactggctaaaaatgcttatctctcacaagatcagacaattaaacgaaaggcccgagagttttttttggcgttagagttgaccaaaaaatacagtaaaaaagatattcttactatgtaccttaacaactcctactttggaaatggagtttggggagttgaagatgccagtcaaaaatattttggaaccacagctgctaacttaacactggatgaagctgccacattagcaggtatgctcaaaggacctgaaatatataacccttaccattctctaaaaaatgctactcaccgtagagatactgttttaggagcgatggttgatgccaaaaagattacccaaacaaaagctcagcaagctagagcagtagggctaaaaaatcgcttagctgatacttatgttggtaagacagatgactacaaatacccatcctactttgatgctgttattagtgaagcaatagcaacttatggtctttcagaaaaagacattgttaataatggatacaaagtttacactgagctagatcaaaattaccaaactggcatgcagacgacttttaacaacgatgaactatttcctgtttcagcttatgacggtagctctgctcaagcagctagtgttgctttagatcctaaaacaggaggtgttagaggtctgattggtcgtgtgaatagtagtgaaaatccgactttcagaagttttaactatgcgactcaagcaaaacgtagtcccgcatcaacaatcaaaccactcgtggtttacgcgccagccgttgcttcaggatggtcaattgaaaaagaactaccaaataccgttcaagatttcgatggctatcagccacataattatggaaattatgaatcagaagatgttcctatgtatcaagcattagcaaactcttataatattccagcagtttctacattgaacgatatcggaatcgataaagcctttacctatggtaaaacatttgggttagatatgagctctgccaaaaaagagttgggggtagctttaggtggcagcgtgacaaccaatccattggagatggctcaggcatatgctgcctttgccaataatggagtaatccatcctgcgcacttgattaaccggattgaaaatgccaggggtgaagtgcttaaaacctttactgataaggctaaacgtgttgtcagccagtctgttgcagataagatgacagccatgatgctaggtaccttttcaaatggaacagcagtcaatgctaacgtatatggctatacactagctggtaaaacagggacgacagaaaccaacttcaatcccgacttagcaggcgatcagtgggttattggttatacgccagatgttgttattagtcaatgggtaggatttaatcagaccgatgaaaatcattatctaacggattcaagtgcaggcacggcctcagctatttttagcactcaggcatcttacattttgccttataccaagggcagccaatttcatgtagataatgcctacgctcaaaatggtatttcagctgtttatggagtcaatgaaacaggtaatcaatcaggagttgatactcaatctattattgatggtttaagaaaatcagcacaagaagcttcgcaatcactatcaaaagcagtcgatcagtcagggttacgtgataaagcccaatctatttggaaagagattgttgactattttaga

SEQ ID NO: 806 - DNA, 1638 bp, Streptococcus pyogenes
atgaccaaaccatttcatcataagaaactaaaacaaataactataatagctgcaactagcctttttttattcctgatcggtggtgccttttactactctaaaaatcattgtattaatgcctatcttaaagctcgatcggcccaatcaggaccagtttttgagaatatcaaagcatatctagtctgggatgatactaatgagcagatcacaaatgacgaggcgatgtatactaagtttagaaggtatagtcagaaagaattgaggcaaaaaaagcaggatttaaaagccgctagtcaagatagtgccgttcaagtaaagtctgttggtcgtcgtttttggatttttcctgattatcggattgccataaaacccatggatttaacgataaaaacgaatgtgcctcaagcagacgttcttttaaatcaaaaaaaagttgctgtttctgattcagaacagttctcagtcaagcttgatcggctaccaacggcagaatataccgcaagtatcagaggcaaacacaacgggcgaaacattaaagtcaacaaatcatatgatggtgataatcccgtgctagatttgagtgtgtcttttagaacttttttggtaacaagcaatgctaagcaaggagatctttacttcgatgataaccatattggcacattaaaagatggtcaattacaagtagaagattaccctgttacagaaaacgcacaagcttatatgaaaacaacattcccagatggtgagttaagatcacaaaaatatgctctagctgatgttgaagaaggagcaaccctggagattttagttacagatcttttagaagaggacaaggcaggggagctattagtatcagcttttgatcagctgatgcactacctcagtacaggtcaagactcatctaacttacgtagcgtctttgaggcagggtctagcaacgcattttataggggattgaaagagtccataaaagcgaaatttcagacagatacaagaaaagccagccgtctcaatattccatctatccttttgacaacaatgactcaagtgggtaaaacaacttacgtgcttgatttcacagctacctacgaatttttgtatgacaagtcaacagatcctgagcagcatacctctggacatattaatcaagacttgactggaaaagtgactgtaaaaaaagttggacagcattaccttatcagccagtccggctccaaaaatattactgttgttaaagaggacaatcaactcaaagcgccatctgtctttcctgagtctattttgggaacgtggacaggccaagccaatggtttgagcatccatatgtctctagcatcagatggaacaattacgactaaagttgaagatcaaaaaggcaaccgttctaaagaaactcggacagctaaaattagtaaagttgaagacaaaggcaatggtttttatctttatacgccagatcctggaagtgacataagcgccttagttccagaaggaggattggggggtgcaaatgtcaaatatgcttatggtttcaaaatatctggtaaaacagcctctccagtggtgtggcaggcagcattaacacatgaatttgattataccaagccactttcgggagtaactttgcaaaagcaacca

SEQ ID NO: 807 - DNA, 540 bp, Streptococcus pyogenes
atgaaacatattttatttattgttggctcgcttcgtgaagggtcttttaaccatcaattagcggctcaagcacaaaaagctctggaacatcaagcagttgtatcttacttaaattggaaagacgttcctgttttgaatcaagatatcgaagctaatgcacctttaccagttgttgacgctcgtcaagctgttcagtcagcggatgctatctggatttttacaccagtttacaacttctctattccaggttctgttaaaaacctgctagactggttgtctcgtgctcttgatttgtctgatccgacgggcccatctgctattggcggtaaggtggttacggtctcttcagttgcaaatggcgggcatgatcaagtatttgatcagtttaaagcactattgccgtttatccgaacttcagtagcaggagagtttacaaaagcaactgtgaatcctgatgcctggggaacaggaaggcttgagatttcaaaagagacaaaagcaaacttgctatctcaggcagaggctcttttagcggctatt

SEQ ID NO: 808 - DNA, 774 bp, Streptococcus pyogenes
ttgttaatgattatttcttttgaaagtgttatattaaaacataataaaataataactcctgaaaagaggctatttatgaaaaaaacaaaacttattttttcttttacttcaatattcattgcaataatttctcgtcctgtgtttggattagaagtagataataattcccttctaaggaatatctatagtacgattgtatatgaatattcagatacagtaattgattttaaaaccagtcataacttagtgactaagaaacttgatgttagagatgctagagatttttttattaactccgaaatggatgaatatgcagccaatgattttaaagatggagataaaatagctatgttctccgtcccatttgattggaactacttgtcagaaggaaaagtcatagcatatacctatggtggaatgacgccttatcaagaagaaccaatgtctaaaaatatccctgttaatttatggattaatagaaagcagattcctgtcccctataatcaaatatcaactaacaaaacaacagttacagctcaagaaattgatctaaaggttagaaaatttttaatatcacaacatcaattatattcttctggttctagctacaaaagtggtaaattagtttttcatacaaatgataattcagataaatattctctcgatcttttctatgtaggatatagagataaagaaagtatttttaaagtatacaaagacaataaatctttcaatatagataaaattgggcatttagatatagaaattgactcc

SEQ ID NO: 809 - DNA, 2442 bp, Streptococcus pyogenes
atgattatgtattcaacgaagatgcaagacatttttagacaggcgcagttccaagctgctcgctttgatagccattgcctggaaacttggcatgttttgttagctatggtagctgtagataattctttagcaaatatgattttaagtgaatatgatgcccaagtcgccatagaagaatatgaagctgcagctattttagccatgggcaaaacccctaaagaacagttgtctcgtgtagacttcagacctcaatctaaaactttgactaacttgttagcttttgcgcaggctattagccaaatcactagggatcaagaagtcggctctgagcatgtcttatttgctattttattgaatccagatattatggcgagtcgtttgttagaaatagctggctatcagataaaagataacggcaatgggcagccgcgattagctgacttgcgaaaagcaatagaacgtcatgcaggttacagtaaggaaatgatcaaggctattcacgaactacgtaagcctaaaaaaacgaaaacacaagggaccttttcagatatgatgaagccaccaagtacagctggtgagttgagtgatttcacaagagatttgactgaaatggcaagacaaggtttgttagaatcggtgattggacgtgaccaagaagtatctcgtatgattcaggtactaagtcgtaaaacgaaaaacaatcctgtcttggtaggtgatgcaggtgttggtaaaactgcgcttgcttatggccttgctcaacggattgcaaatggcgctattccttatgaacttaaggagatgcgtgtcctagaattagacatgatgagtgtggtagcaggaacccgttttcgtggggattttgaagagcgcatgaatcaaatcattgatgatattgaagctgatggtcagattattctttttgttgatgaactacatactattatgggttctggcagtggtattgacagtacacttgatgcggctaacattttaaaaccagcattatcgcgcggcactcttcatatggttggagcaacaactcaagaagaataccaaaaacatattgaaaaagatgcagctctttcgcgtcgttttgctaaaatattaattgaagaacctaatacagaagatgcttatcagattttgatgggcctaaaattatcttatgagacctaccataatgtctcgatatcaaatgaggcagttaaaacagctgtaaaaatggcacaccgttatttaaccagtaaaaatctccctgattcagctatcgatttactagatgaagctagtgctgctgtgcaaaacatggtgaaaaaatcagcacctgagactttaacaccaatagaccaagctcttatcaatggtgatatgaaaaaagtatctcgcctcttagctaaagaagcaaaaggtcagatgagaaaaccaacaccggtgacagaagatgatattttggcaaccttgagtaagttatcgggaattccacttgaaaaactgacgcaagctgatagtaaaaaatacctcaatttagaaaaagaactgcataagcgtgtgattggtcaggatgctgctgttacggctatttcaagagccattcgtcgtaatcagtcaggtattcgaacaggaaaacgtcctattggatcatttatgtttcttggcccaacaggagtaggtaagacagaactagcaaaggcccttgcagaagttctctttgatgatgaagcagcgcttattcgttttgatatgtctgagtacatggaaaaattcgcagcgtctaggcttaatggagcacctcctggttatgtcggctatgatgaaggaggtgaactgacacagaaagttagaaataaaccttattcagtcttgctttttgatgaagtggaaaaagcacatcctgatatttttaacgttctccttcaagtattagatgatggtatattgactgatagtcgtgggcgtaaggtcgatttttcaaatactattattatcatgaccagcaatcttggcgcaacagccctgcgcgatgataaaacggtcggttttggggtcaaagacattcaccaagaccatcaagctatggagaaacgtattttagaagaattaagaaaaacttaccgcccagaatttatcaatcgtattgatgaaaaagtggtctttcatagtctgacccaagataacatgcgcgatgtggttaaaatcatggtacagcccctgattactacattggcagaaaaaggtattacccttaaaattcagcctttggccttgaaacatttgtccgaggtcggctatgatgagcatatgggggcaagaccattacgtcgaacgctgcaaactgagatagaagataagctatcagagcttattctttctcgagaattgacaagtgggcatacgctaaaaattggattatcacatggcaaattaacgtttcacatagct

SEQ ID NO: 810 - DNA, 1494 bp, Streptococcus pyogenes
ttgaaaagggttcccgtagaaagagacaaacgcttagtctctttctttttctttcttctcatttctgttataataagtcaggtaactacattagaaagatttgtgggtctgtcatctaagagatgtcattcccgaagaggtattagtgacttgtctcaatcaactgcaacttatattaatgttattggagctgggctagctggttctgaagctgcctatcagattgctaagcgcggtatccccgttaaattgtatgaaatgcgtggtgtcaaagcaacaccgcaacataaaaccactaattttgccgaattggtctgttccaactcatttcgtggtgatagcttaaccaatgcagtcggtcttctcaaagaagaaatgcggcgattagactccattattatgcgtaatggtgaagctaaccgcgtacctgctgggggagcaatggctgttgaccgtgaggggtatgcagagagtgtcactgcagagttggaaaatcatcctctcattgaggtcattcgtggtgaaattacagaaatccctgacgatgctatcacggttatcgcgacgggaccgctgacttcggatgccctggcagaaaaaattcacgcgctaaatggtggcgacggattctatttttacgatgcagcagcgcctatcattgataaatctaccattgatatgagcaaggtttaccttaaatctcgctacgataaaggcgaagctgcttacctcaactgccctatgaccaaagaagaattcatggctttccatgaagctctgacaaccgcagaagaagccccgctgaatgcctttgaaaaagaaaagtattttgaaggctgtatgccgattgaagttatggctaaacgtggcattaaaaccatgctttatggacctatgaaacccgttggattggaatatccagatgactatacaggtcctcgcgatggagaatttaaaacgccatatgccgtcgtgcaattgcgtcaagataatgcagctggaagcctttataatatcgttggtttccaaacccatctcaaatggggtgagcaaaaacgcgttttccaaatgattccagggcttgaaaatgctgagtttgtccgctacggcgtcatgcatcgcaattcctatatggattcaccaaatcttttaaccgaaaccttccaatctcggagcaatccaaaccttttctttgcaggtcagatgactggagttgaaggttatgtcgaatcagctgcttcaggtttagtagcaggaatcaatgctgctcgtttgttcaaaagagaagaagcacttatttttcctcagacaacagctattgggagtttgcctcattatgtgactcatgccgacagtaagcatttccaaccaatgaacgtcaactttggcatcatcaaagagttagaaggcccacgcattcgtgacaaaaaagaacgttatgaagctattgctagtcgtgctttggcagatttagacacctgcttagcgtcgctt

SEQ ID NO: 811 - DNA, 885 bp, Streptococcus pyogenes
atggaacgtttaagaagaacaatgatgtttgtgcctggtgccaatgcagccatgcttcgagatgctcctttatttggcgctgattcaatcatgtttgacttggaagattctgtttcactcaaagaaaaagacacctctagagctctcgttcattttgcgcttaaaacttttgattattcaagcgttgaaacggttgttcgtgtgaatggtcttgattcttgtggggctttagacatcgaagctgttgttttggcaggtgtcaacgtgattcgtcttccaaaaacagagactgctcaagatattattgatgtggaggctgttattgaacgtgtcgaacgcgagaacagcattgaagttggtcgcacacgtatgatggcagccattgaatcagccgaaggtgtcctaaatgctcgtgagattgccaaagcttctaagcgcttgattggtattgctcttggagcagaagactatgtcacgaatatgaaaacgcgtcgttacccagatggtcaagaattattctttgctcgtagcatgattttacacgctgctcgtgctgctggaattgctgccattgatactgtttattctgatgtcaataataccgaagggttccaaaacgaagttcgcatgatcaaacagttaggatttgatggtaaatcggtcatcaaccctcgccaaattcctctggtcaatgagatttataccccaacaaaaaaagaaattgaccatgccaaacaagtcatctgggcaattcgtgaagctgaaagcaaaggctctggcgttatttccttaaatggaaaaatggttgataaaccaatcgttgaacgtgcagaacgtgtgattgccctagcaacagcagcaggtgttttatctgaggaggatatt

SEQ ID NO: 812 - DNA, 1491 bp, Streptococcus pyogenes
ttgatagaaaaatacttggaatcatcaatcgaatcaaaatgtcagttaattgtcttgttttttaagacatcttatttgccaataactgaggtagcagaaaaaactggcttaacctttttacaactaaaccattattgtgaggaactgaatgcctttttccctggtagtctgtctatgaccatccaaaaaaggatgatatcttgccaatttacacatccttttaaagaaacttatctttaccaactctatgcatcatctaatgtcttacaattactagcctttttaataaaaaatggttcccactctcgtccccttacggattttgcaagaagtcattttttatcaaactcctcagcttatcggatgcgcgaagcattgattcctttattaagaaactttgaattaaaactctctaagaacaagattgtcggtgaggaatatcgcatccgttacctcatcgctctgctatatagtaagtttggcattaaagtttatgacttgacgcagcaagacaaaaacactattcatagctttttatcccatagttccacccaccttaaaacctctccttggttatcggaatcgttttctttctatgacattttattagctttatcgtggaagcggcatcaattttcggtaactattccccaaaccagaatttttcaacaattaaaaaaactttttgtctacgattctttgaaaaaaagtagccatgatattatcgaaacttactgccaactaaacttttcagcaggagatttggactacctctatttaatttatatcaccgctaataattcttttgcgagcttacaatggacacctgagcatatcagacaatattgtcaactttttgaagaaaatgatacttttcgcctgcttttaaatcctatcatcactcttttacctaacctaaaagagcaaaaggctagtttagtaaaagctcttatgtttttttcaaaatcattcttgtttaatctgcaacattttattcctgagaccaacttattcgtttctccgtactataaaggaaaccaaaaactctatacgtccttaaagttaattgtcgaagagtggatggccaaacttcctggtaagcgtgacttgaaccataagcattttcatcttttttgccactatgtcgagcaaagtctaagaaatatccaacctcctttagttgttgttttcgtagccagtaattttatcaatgctcatctcctaacggattcttttccaaggtatttctcggataaaagcattgattttcattcctattatctattgcaagataatgtttatcaaattcctgatttaaagccagatttggtcatcactcacagtcaactgattccttttgttcaccatgaacttacaaaaggaattgctgttgctgaaatatcttttgatgaatcgattctgtctatccaagaattgatgtatcaagttaaagaggaaaaattccaagctgatttaaccaagcaattaaca

SEQ ID NO: 813 - DNA, 1083 bp, Streptococcus pyogenes
atgacaaaattagaccaaatacgtttgtatcttgaccaaaagggagctgaattggcgattttctcagatcctgttacgattaactatttaaccggattcttctgtgacccacatgaaagacaactgttcttgtttgtctaccatgatttagctcctgtgctttttgtacctgcccttgaggtggccagagctagccaggccatatcatttcctgtgtttggttatgttgactctgaaaatccttgggaaaagatcaaggccgttttaccaaatacagcagccaaaaccatttatgctgaatttgaccaccttaacgtcaataagttccatggcttgcagactatcttttcaggacaatttaacaatctaaccccttatgtccaaggcatgcgcctcgtcaaatcagctgatgaaatcaataaaatgatgattgccgggcagttcgctgataaggctgttcaagttggttttgacaatatttccttagatgctaccgaaacagacgtcatcgctcaaattgagtttgaaatgaaaaaacaaggcattcataaaatgagctttgacactatggtcttaactggaaataatgcagccaatccccatggcattcctggaacaaataacattgaaaacaatgccctacttctctttgacttaggtgttgagaccttaggctacaccagtgatatgaccagaactgtggctgttggtcagccagaccaatttaaaatcgatatctacaatctctgcctagaggcacaactagcggctattgactttatcaaaccaggtgtaacagctgctcaagtagatgctgctgctcgtcaagtgattgaaaaggctggatatggtgagtacttcaaccaccgcttgggacatggtatcggcatggatgtccacgaatttccctccattatggctggcaatgacttggtccttgaagaaggtatgtgcttctctgttgaacctggtatttacattccaggaaaggtcggtgtgcgcatcgaagactgtggccatgtcactaaaaatggctttgaagtctttacccatactccaaaagagttgctttattttgaaggc

SEQ ID NO: 814 - DNA, 1356 bp, Streptococcus pyogenes
atgaaagtgataagtaattttcaaaacaaaaaaatattaatattggggttagccaaatcgggcgaagcagcagcaaaattattgaccaaacttggtgctttagtgactgttaatgatagtaaaccatttgaccaaaatccagcggcacaagccttgttggaagaggggattaaggtcatttgtggtagccacccagtagaattattagatgagaactttgagtacatggttaaaaaccctgggattccttatgataatcctatggttaaacgcgcccttgcaaaggaaattcccatcttgactgaagtagaattggcttatttcgtatctgaagcgcctattatcgggattacaggatcaaacgggaagacaaccacaacgacaatgattgccgatgttttgaatgctggcgggcaatctgcactcttatctggaaacattggttatcctgcttcaaaagttgttcaaaaagcaattgctggtgatactttggtgatggaattgtcctcttttcaattagtgggagtgaatgcttttcgccctcatattgctgtcatcactaatttaatgccgactcacctggactatcatggcagttttgaggattatgttgctgctaaatggatgattcaagctcagatgacagaatcagactaccttattttaaatgctaatcaagagatttcagcaactctagctaagaccaccaaagcaacagtgattcctttttcaactcaaaaagtggttgatggagcttatctgaaggatggaatactctattttaaagaacaggcgattatagctgcaactgacttaggtgtcccaggtagccacaacattgaaaatgccctagcaactattgcagttgccaagttatctggtattgctgatgatattattgcccagtgcctttcacattttggaggcgttaaacatcgtttgcaacgggttggtcaaatcaaagatattaccttctacaatgacagtaagtcaaccaatattttagccactcaaaaagctttatcaggttttgataacagtcgcttgattttgattgctggcggtctagatcgtggcaatgaatttgacgatttggtgccagaccttttaggacttaagcagatgattattttgggagaatccgcagagcgtatgaagcgagctgctaacaaagcagaggtctcttatcttgaagctagaaatgtggcagaagcaacagagcttgcttttaagctggcccaaacaggcgatactatcttgcttagcccagccaatgctagctgggatatgtatcctaattttgaggttcgtggggatgaatttttggcaacctttgattgtttaagaggagatgcc

SEQ ID NO: 815 - DNA, 1896 bp, Streptococcus pyogenes
atgattcagattggcaaattatttgctggtcgttatcgcattctgaaatctattggccgcggtggtatggcggatgtttatttagcaaatgacttgatcttggataatgaagacgttgcaatcaaggtcttgcgtaccaattatcaaacagatcaggtagcagttgcgcgtttccaacgagaagcgcgggccatggctgaattgaaccatcccaatattgttgccatccgggatataggtgaagaagacggacagcaatttttagtaatggaatatgtggatggtgctgacctaaagagatacattcaaaatcatgctccattatctaataatgaagtggttagaattatggaagaagtcctttctgctatgactttagcccaccaaaaaggaattgtacacagagatttaaaacctcaaaatatcctactaactaaggagggtgttgtcaaagtaactgatttcggcatcgcagtagcctttgcagaaacaagcttgacacaaactaattcgatgttaggcagtgttcattacttgtctccagaacaggctcgcggctccaaagcgacgattcaaagtgatatttatgcgatggggattatgctctttgagatgttgacaggccatatcccttatgacggcgatagtgctgttacgattgccttgcaacattttcaaaagcctcttccatctattatcgaggagaaccacaatgtgccacaagctttggagaatgttgttattcgagcaacagccaagaaattaagtgatcgttacgggtcaacctttgaaatgagtcgtgacttaatgacggcgcttagttataatcgtagtcgggagcgtaagattatctttgagaatgttgaaagtaccaaacccctccccaaagtggcctcaggtcccaccgcttctgtaaaattgtctccccctaccccaacagtgttaacacaggaaagtcgattagatcaaactaatcaaacagatgctttacagccccccaccaaaaagaaaaaaagtggtcgttttttaggtactttattcaaaattcttttttctttctttattgtaggtgtagcactctttacttatcttatactaactaaaccaacttctgtgaaagttcctaatgtagcaggcactagtcttaaagttgccaaacaagaactgtatgatgttgggctaaaagtgggtaaaatcaggcaaattgagagtgatacggttgctgagggaaatgtagttagaacagatcctaaagcaggaacagctaagaggcaaggctcaagcattacgctttatgtgtcaattggaaacaaaggttttgacatggaaaactacaaaggactagattatcaagaagctatgaatagtttgatagaaacttatggtgttccaaaatcaaaaatcaaaattgagcgcattgtaactaatgaatatcctgaaaatacagtcatcagtcaatcgccaagtgcgggtgataaatttaatccaaacggaaagtctaaaattacgctcagtgttgctgttagtgatacgatcactatgcctatggtaacagaatatagttatgcagatgcagtcaataccttaacagctttaggtatagatgcatctagaataaaagcttatgtgccaagctctagctcagcaacgggctttgtgccaattcattctcctagttctaaagctattgtcagtggtcaatctccttactatggaacgtctttgagtctgtctgataaaggagagattagtctttacctttatccagaagaaacacactcttctagtagctcatcgagttcaacgtcaagttcaaacagttcttcaataaatgatagtactgcaccaggtagcaacactgaattaagcccatcagaaactacttctcaaacacct

SEQ ID NO: 816 - DNA, 2985 bp, Streptococcus pyogenes
atggataaacatttgttggtaaaaagaacactagggtgtgtttgtgctgcaacgttgatgggagctgccttagcgacccaccatgattcactcaatactgtaaaagcggaggagaagactgttcaggttcagaaaggattaccttctatcgatagcttgcattatctgtcagagaatagcaaaaaagaatttaaagaagaactctcaaaagcggggcaagaatctcaaaaggtcaaagagatattagcaaaagctcagcaggcagataaacaagctcaagaacttgccaaaatgaaaattcctgagaaaataccgatgaaaccgttacatggttctctctacggtggttactttagaacttggcatgacaaaacatcagatccaacagaaaaagacaaagttaactcgatgggagagcttcctaaagaagtagatctagcctttattttccacgattggacaaaagattatagccttttttggaaagaattggccaccaaacatgtgccaaagttaaacaagcaagggacacgtgtcattcgtaccattccatggcgtttcctagctgggggtgataacagtggtattgcagaagataccagtaaatacccaaatacaccagagggaaataaagctttagccaaagctattgttgatgaatatgtttataaatacaaccttgatggcttagatgtggatgttgaacatgatagtattccaaaagttgacaaaaaagaagatacagcaggcgtagaacgctctattcaagtgtttgaagaaattgggaaattaattggaccaaaaggtgttgataaatcgcggttatttattatggatagcacctacatggctgataaaaacccattgattgagcgaggagctccttatattaatttattactggtacaggtctatggttcacaaggagagaaaggtggttgggagcctgtttctaatcgacctgaaaaaacaatggaagaacgatggcaaggttatagcaagtatattcgtcctgaacaatacatgattggtttttctttctatgaggaaaatgctcaagaagggaatctttggtatgatattaattctcgcaaggacgaggacaaagcaaatggaattaacactgacataactggaacgcgtgccgaacggtatgcaaggtggcaacctaagacaggtggggttaagggaggtatcttctcctacgctattgaccgagatggtgtagctcatcaacctaaaaaatatgctaaacagaaagagtttaaggacgcaactgataacatcttccactcagattatagtgtctccaaggcattaaagacagttatgctaaaagataagtcgtatgatctgattgatgagaaagatttcccagataaggctttgcgagaagctgtgatggcgcaggttggaaccagaaaaggtgatttggaacgtttcaatggcacattacgattggataatccagcgattcaaagtttagaaggtctaaataaatttaaaaaattagctcaattagacttgattggcttatctcgcattacaaagctcgaccgttctgttttacccgctaatatgaagccaggcaaagataccttggaaacagttcttgaaacctataaaaaggataacaaagaagaacctgctactatcccaccagtatctttgaaggtttctggtttaactggtctgaaagaattagatttgtcaggttttgaccgtgaaaccttggctggtcttgatgccgctactctaacgtctttagaaaaagttgatatttctggcaacaaacttgatttggctccaggaacagaaaatcgacaaatttttgatactatgctatcaactatcagcaatcatgttggaagcaatgaacaaacagtgaaatttgacaagcaaaaaccaactgggcattacccagatacctatgggaaaactagtctgcgcttaccagtggcaaatgaaaaagttgatttgcaaagccagcttttgtttgggactgtgacaaatcaaggaaccctaatcaatagcgaagcagactataaggcttaccaaaatcataaaattgctggacgtagctttgttgattcaaactatcattacaataactttaaagtttcttatgagaactataccgttaaagtaactgattccacattgggaaccactactgacaaaacgctagcaactgataaagaagagacctataaggttgacttctttagcccagcagataagacaaaagctgttcatactgctaaagtgattgttggtgacgaaaaaaccatgatggttaatttggcagaaggcgcaacagttattggaggaagtgctgatcctgtaaatgcaagaaaggtatttgatgggcaactgggcagtgagactgataatatctctttaggatgggattctaagcaaagtattatatttaaattgaaagaagatggattaataaagcattggcgtttcttcaatgattcagcccgaaatcctgagacaaccaataaacctattcaggaagcaagtctacaaatttttaatatcaaagattataatctagataatttgttggaaaatcccaataaatttgatgatgaaaaatattggattactgtagatacttacagtgcacaaggagagagagctactgcattcagtaatacattaaataatattactagtaaatattggcgagttgtctttgatactaaaggagatagatatagttcgccagtagtccctgaactccaaattttaggttatccgttacctaacgccgacactatcatgaaaacagtaactactgctaaagagttatctcaacaaaaagataagttttctcaaaagatgcttgatgagttaaaaataaaagagatggctttagaaacttctttgaacagtaagatttttgatgtaactgctattaatgctaatgctggagttttgaaagattgtattgagaaaaggcagctgctaaaaaaa

SEQ ID NO: 817 - DNA, 591 bp, Streptococcus pyogenes
atgaaacagtttattaaagaatggggcccattcactctctttttaattctctttggtctatctcgtctttttttgtggcaggctgttaaagtagacggccattctatggacccaactctagctcatggcgaacgccttatcgtttttaatcaagctagaattgatcgctttgatattgtagttgctcaggaagaagaaaacggacaaaagaaagaaatcgtaaaaagagttattggattgccaggcgataccatttcttataatgatgacacactttatattaatggtaaaaaaacagttgagccgtatttggctgagtatctaaaacaatttaaaaacgataaactccaaaaaacttacgcctataataccctattccaacagttagcagaaacatctgatgcttttacaactaattctgagggacaaacacgctttgagatgagtgttccaaaaggagaataccttcttcttggtgatgatcgtattgtttccagggatagtcgcgaagttggtagtttcaaaaaagaaaaccttatcggtgaagtgaaagctcgtttttggccactcaataaaatgaccgtttttaat

SEQ ID NO: 818 - DNA, 264 bp, Streptococcus pyogenes
atgaataagcgaatcaaaaagaaacgtaaactcgaacgggctattgtgatgctggttgcggaaaatgctatgcaagcagaagcaattaaaaatcaaaacaaagaaatcatggagctaaaatcaatcgttcaacgaaacgctctggcaacaaacgaagagtttgcgtctgttaaagctgctactttagataaccaatcagctattgcagatattgcaattgacgttaactatattaagaaaaattacaagcgaaaatggggaaaa

SEQ ID NO: 819 - DNA, 696 bp, Streptococcus pyogenes
atgaagacacttgcatttgatacctcaaataaaaccttgtcccttgctatacttgatgatgagacacttctagcagatatgacccttaacattcagaaaaaacatagtgttagccttatgcctgctattgattttttgatgacttgtactgatcttaaacctcaagatttagaaagaatagtggttgcaaaaggccctggatcttacacaggtttacgagtggcagttgctactgcaaaaacgttagcgtacagtttaaatattgcattggtcgggatttcgagtctatatgctttggctgcgtctacttgtaaacagtatccaaatactttggtggtgccattgattgatgctagaaggcaaaatgcgtatgtaggttattatcggcaaggaaaatcagtgatgccacaagcccatgcttcactagaagttattatagaacaattagtagaagaaggacagctgatttttgttggggagactgctccttttgctgagaaaattcaaaagaaactacctcaggcgatactacttccaacccttccttctgcttacgaatgtggtcttttggggcaaagtttggcaccagaaaatgtagacgcctttgtccctcaatatctcaagagagtggaagctgaagaaaactggctcaaagataatgagataaaagatgatagtcactacgttaagcgaatc

SEQ ID NO: 820 - DNA, 2229 bp, Streptococcus pyogenes
atgaggaacgaaatggcaaaaataatgaacgtaacaggagaagaagtcattgccttagcggccacctatatgaccaaggctgatgtggcttttgtggcaaaggctttagcatatgcaacagcggcccatttctaccaagtgagaaagtcaggcgaaccctatatcgtccatccgattcaggtggcggggattctggctgatttgcatctggatgctgtgacagttgcttgtggctttttacatgatgtcgtagaagatacggatattaccttagatgagatcgaagcagactttggccatgatgctcgtgatatcgttgatggtgtcaccaagttaggtgaagttgagtacaaatctcatgaggagcaactcgccgaaaaccatcgcaaaatgctgatggctatgtccaaagatattcgcgtgattttggtgaaattggctgaccgcctgcataatatgcgcaccctcaaacatttgcgcaaggacaaacaagagcgcatttcgcgcgaaaccatggaaatctatgcccccttggcgcatcgtttggggattagtcgcatcaaatgggaactagaagatttggcttttcgttacctcaatgaaaccgaattttacaaaatttcccatatgatgaaagaaaaacgtcgcgagcgtgaagctttggtagaggctattgtcagtaaggtcaaaacctatacgacacaacaagggttgtttggagatgtgtatggccgaccaaaacacatttattcgatttatcggaaaatgcgggacaaaaagaaacgattcgatcagatttttgatctgattgccattcgttgtgtcatggaaacgcaaagcgatgtctatgctatggttggctatattcatgagctttggcgtcccatgccaggccgcttcaaggattatattgcagctcctaaagctaatggctaccagtctattcataccaccgtgtatgggccaaaaggacctattgagattcaaatcagaactaaggacatgcatcaagtggctgagtacggggttgctgctcactgggcttataaaaaaggcgtgcgtggtaaggtcaatcaagctgagcaagccgttggcatgaactggatcaaagagctggtagaattgcaagatgcctcaaatggcgatgcagtggactttgtggattcggtcaaagaagacattttttctgaacggatttatgtctttacaccgacaggggccgttcaggagttaccaaaagaatcaggtcctattgattttgcttatgcgatccatacgcaaatcggtgaaaaagcaacaggtgccaaagtcaatggacgtatggttcctctcactgccaagttaaaaacaggagatgtggttgaaatcatcaccaatgccaattcctttggccctagtcgagactgggtaaaactggtcaaaaccaataaggctcgcaacaaaattcgtcagttctttaaaaatcaagacaaggaattgtcagtgaataaaggccgtgatttgttggtgtcttattttcaagagcagggctacgttgccaataaataccttgacaaaaaacgcattgaagccatccttccaaaagtcagtgtgaagagcgaagaatcactctatgcagccgttgggtttggtgacattagtcctatcagtgtctttaacaagttaaccgaaaaagagcgccgtgaagaagaaagggccaaggctaaagcagaagctgaagaattggttaagggcggtgaggtcaaacacgaaaacaaagatgtgctcaaggttcgcagtgaaaatggagtcattatccaaggagcatcaggcctcttgatgcggattgccaagtgttgtaatcctgtacctggtgatcctattgacggctacattaccaaagggcgtggcattgcgattcacagatcggactgtcataacattaagagtcaagatggctaccaagaacgcttgattgaggtcgagtgggatttggacaattcgagtaaagattatcaggctgaaattgatatctatgggctcaatcgtagtggtctgcttaatgatgtgctccaaattttatcaaactcaaccaagagcatatcgacagtcaatgctcagccgaccaaggacatgaagtttgctaatattcacgtgagctttggcattccaaatctgacgcatctgaccactgttgtcgaaaaaatcaaggcagttccagatgtttatagcgtgaagcggaccaatggc

SEQ ID NO: 821 - DNA, 1134 bp, Streptococcus pyogenes
ttggcaaaaaaattaaaaaagaatgaagaaatcactaagaagtttggtgacgaacgtcgcaaagcccttgatgatgctttgaaaaatattgaaaaagattttggtaagggtgcagtgatgcgattaggagaacgtgcagagcaaaaagttcaggttatgagttcaggaagtctagctcttgatattgcgcttggagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaactcctcttgtctcaaccagattctggagaacaaggacttgaaattgcaggtaaattgattgattctggtgcggttgatctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgctatctttattaaccaattgcgtgaaaaagttggtgtgatgtttggaaatcctgaaacaacaccaggtggtcgagctttgaaattctatgcttctgttcggctggatgtgcgtggaacaactcaaattaaaggaactggtgaccaaaaagatagcagtattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcacccagaattgtttgatgaaatcgaccttaaagtacgtgttaaatttggtttgcttgaagaaagcgaagaagaatctgctatggcagtagcatcagaagaaaccgatgatcttgctttagatttagataatggtattgaaattgaagat

SEQ ID NO: 822 - DNA, 996 bp, Streptococcus pyogenes
atgtcagaaacaaaattaatggctttgcgtgaagcagtcaaccttgctatgactgaggaaatgcgcaaggacgaaaacattttccttatgggagaagacgtaggggtttacggaggagactttgggacttctgttggaatgattgaagaatttggccctaaacgtgttaaagataccccaatttcagaagctgctatctctggtgcggctattggtgcagctattacaggactacgtccaattgtcgacgttaccttcatggatttccttaccatcatgatggacgctatcgtgaataatggtgctaaaaataattacatgttcggtggaggccttattacccctgtaaccttccgtgtggcatcaggttctggtattggttccgctgcgcaacactcacaatctcttgaggcatggttgactcacattccaggaatcaaagttgttgctcctggtaatgccaacgatgctaaaggcttattaaaatcagctatccgtgataataacattgttcttttcatggaaccaaaagcgctttatggtaaaaaagaagaagttaaccaagatcctgacttctatatcccacttggcaaaggtgacatcaaacgtgaaggaactgatttgacaattgtgtcatacggtcgtatgttggagcgtgttcttcaagcggctgaagaagtagcagcggatggtattaacgttgaagttgttgacccacgtaccctcatcccacttgataaagagttgattattgaatctgttaagaaaacaggtaaattgatgcttgtcaacgatgcctacaagaccggtggattcattggggaaattgcaaccatgattaccgaaagtgaagcctttgattaccttgatcatccaatcgttcgtcttgcaagtgaagatgttccagtaccttatgctcgtgtacttgaacaagcaatcttaccagatgttgagaaaatcaaagctgctattgtgaaaatggcaaacaaaggcaac

SEQ ID NO: 823 - DNA, 1761 bp, Streptococcus pyogenes
atggctgttgaaattattatgccaaaactcggtgttgacatgcaagaaggtgaaatcatcgagtggaaaaaacaagaaggtgatactgtcaatgaaggcgatattcttcttgaaatcatgtcagataaaaccaatatggaacttgaggcagaagactcaggtgttcttcttaaaattacacgtcaagcaggtgaaacagtacctgtaacagaagttatcggatatatcggtgctgaaggtgaatctgttgaggtttctagcccagctgcttcagatgtgaatgttgctcgtacaacagaagatttagaagctgctggacttgaagtgccaaaagcaccagctcaagctgcttcagctgcaccaaaagctgcacttgctgatgatgagtatgacatcatcgttgttggtggtggccctgcaggttattatgcagctattcgtggtgctcaacttggtggtaaaattgccatcgttgagaaatctgaatttggtggaacttgcttgaacgtagggtgtatcccaaccaaaacttaccttaaaaatgctgaaatccttgatggtattaagattgcagcaggacgtgggattaaccttgcctcaactaactatactattgacatggacaaaacagttgactttaaaaacaccgttgttaaaaccttaacaggcggcgttcaaggtcttctaaaagctaataaagtcactatctttaatgggcttggtcaagtcaaccctgacaagactgtaaccattgggtcacaaaccattaagggtcgcaacgttatccttgctacaggttctaaagtatcacgtatcaatatcccaggtattgactctaaacttgtcttaacgtcagatgatatccttgacctccgtgaaatgccaaaatcactagcagttatgggcggtggtgttgttggtatcgagcttggacttgtttgggcatcttacggtgtggatgttaccgttattgaaatggctgaccgtattatcccagctatggataaagaagtctctcttgaacttcaaaaaatcctttctaagaaaggcatgaagatcaaaacatctgttggtgtctctgaaattgttgaagcaaataaccaattgactttgaaacttaacaatggtgaagaagttgttgctgaaaaagctcttctttctatcggacgtgtatcacaaatgaacggtctggaaaatcttaaccttgaaatggatcgtaaccgtatcaaagttaatgactaccaagagacatcaattccaggtatctatgcgccaggtgacgttaacggaacgaaaatgcttgctcacgctgcttaccgtatgggtgaagtggctgcagaaaatgcgatgcatggcaacacaactcgtaaagctaaccttaaatacactccagcagctgtttacacacaccctgaagtggcaatggttggtttaactgaagaacaagcgcgtgaacaatatggtgatgtgcttattggtaaaaacagctttactggtaatggacgcgcgattgcttcaaatgaagcacatggttttgttaaagttattgctgatgccaaataccacgaaatcttaggtgttcatattattggtccagctgcagctgagatgattaacgaagcagctactattatggaatctgaattaaccgttgatgaattgttattatcaattcatggacacccaaccttctctgaagtgatgtacgaagcctttgcagatgtgcttggcgaagctatccataacccaccaaaacgtaag

SEQ ID NO: 824 - DNA, 1773 bp, Streptococcus pyogenes
atgagaataaaatggttttcgtttgttagggtaacaggacttttactggttttactctaccacttttttaaaaatgtatttccaggaggttttattggtgttgacattttcttcaccttttcaggatatctaatcacagccctcttgattgatgaatacacaaaaaaagagtctatcgatattatcggttttttaaaaagacgcttttatcgaattgttcctcctttggtgttaatgattttattgaccattccttttacgtttttaattaagaaggatttcattgctaatataggaagtcagattacagctgttttaggatttaccactaatatttatgaaatattgacgggaagtagttatgaaagccaatttattccacatctctttgttcatacgtggagcttagctattgaagttcatttttacttgttttggggtgtatttgtttggttattagctagacgcaaggagactcagaaacaactgagaggactactgtttttgatttctttgggaatatttgctattagtttcttgagcatgtttataagatcttttatgacctcaaatttttccctgatttatttttcgagtctttctcacagttttcccttctttttaggggcgatgtttgccacgataacaggtattaacgagactactgttcgatttcaaaaaaatgtacgtttatggccgcgccagtatgtccttgctgctatgattggagcatttacacttttgcttgtgctaacggtcacattggattttaaccatatcacgacctatctatttggctttgctttggctagcttattcgcatcaattatgatttatgcagcgcgtgttcttcatgagcaaacaccagatgtacaagagcctaaagctatcacttatatagctgatattagctatgggatttacctcttccattggccattttacattatttttagccaattaatgtctcatattttggcagttattctaacagttttcttttcaatcttgtttgccactgtgtcttactatattgtggaacctttggtccaagggagaaaaccaaacctgcttggtttagaaattgactgttctccttactataagtggattgtaggagggtctctcgccttagcattattaactttaggaacttgtatgatagcgcctaaagttggtaagtttgagaaacaattgttggtcagttccctacaacaggctcaaagtaatatggagcggacacatacactagctgcaggagacgctaatgctttgagtgacgtaggtattattggtgattctgtagcattacgctctagtgcagcattctcacaaattatgccacaagcgcaactggatgcagcggtcagtcggaattttaaagaagctttcgatttatttaataaccaaattaaatctaagagtctatctaagactgttgtcttagcagtaggtgttaactcgcttgacaactattctcaagcagttcagtcttttattgaggcattgccaaaaggtcatcgtttagttttggtttctccatataatgccaaaaatgccagtcaggttgcagaagctagagactatggtcttaaattgtccaaaaaatacaagtatgtcactattgcagactggtataaagttgctgttgaacatccagatatttggtatggcagtgatggtgttcattatagtgaagatagtcaaggagcagaactatatgtctccacaatccagactgctgttgagaagtcagctaaaaaaccagctaaa

SEQ ID NO: 825 - DNA, 1998 bp, Streptococcus pyogenes
atggccattagtcaaatgaaaaagctggcaatggtttttgaaaaagattatcttgatcttgttttaaaaacacttcaacaatctcaattagttgaagttcgtgacatgaagcaactaaaacattggcaagatgcttttaacaaaggcaacgtcaagttgccacaaatcgtccaatacgatctgacgcatcaaaaacctctactagatgatgaagctttacaataccttttacaaagccaacaagagttagaaaacggccttgctagcttatcagcgtttttaccaccaataggaaagttaacagccttgagacaaaaaacgccatctctttcgtttaaacagttcgaagaacgccatcgacaacaagcagctcaaacggctttgaaaatgatgtcacaaaagatagagcgactagagcagctgcaaagcaaaatagaccagctaacagaatactgtcaggagttagaaaagtggcgttccttgactgttttgcctcaggacttagcgcaatttcattttttgtcggcaagagttggaacgattcctagtacagcaaataatcatttttatcatcagctaaagcagcacaaaggtctttttattgaggaagtataccatacagaatttgagtacggccttgtcttattttggcaagcacaagatacgattcatttacagaaatatcagtttaaacccttattatataaagaacagttactgccatcagaacaacttcgtataaacaaagagttactaacgaattggctagctgaaaaagatagtctactaaaagagcttaggcagtctcaaaagatactggcacagttacaggttgaaatagactatgtccttagtcagtatcaacggcagcaaactaaaaagcaattactcggtacaagacatctaatagccttagaagggtggatagaagctgattcggttaaccaattaaaagggctaatgactaagacactaggtgatatgttttatctggatagttacgatgtcacgccagacgattgggaagatgttcccattaagctacgtaatcaccgctacattgcaccgtttgaattggttacagaaatgtacgctttgccaaaatatcaagaaaaagatccgacaccttttttagctcctttataccttactttttttggcatgatggtagctgatttgggctatggtttgttgctatatgctgtgacactagctgcattggtcttttttaatctccaaaaaaccagtaaacggttagtgaccttctttaatattttagctatttcagtagccatatgggggcttatttacggttctttctttggttttgacttacctgtggcattattatcaactaaaacggatgtgattactattttggttgtttctttgctatttgggtttgttacacttatatttgggcttttgttaggagcatggcaacaagtaaggatgaaagcatatgctacggcctatacgtcaagtctagcttggacttttattttattaggtctgctgttatttattcttggtaagaatgtatctggccttgcttacttatcggttattggtaagtggcttgcattgggcaatgcctttgggattttggttgtttctttactaaaaagcaaaagccttttaggtctaggtagtggattatataatttatatggcattagctcttacttaagtgatttggttagctttactcgtctaatggcattagggctttctggagctagtattggagcggcttttaacatgattgttgggatttttccaccagtcacgcgctttacagtaggtatctttatttttattcttttgcatgcgatcaatattttcttatcaatgctttcaggatatgtgcatggtgctcgtcttattttcgtagagttttttggaaaattttatgaaggtggaggaaaagctttcaatcctttaaagttagctgataattatgtcaatgtcaatgaagaaacagatttggaggacaat

SEQ ID NO: 826 - DNA, 1725 bp, Streptococcus pyogenes
ttggaaacgatattacaaacaaaattaccagtagctcaactggtggagcagctaacggagtggctaactaaaactttctcaggtctatttgatattatgcaagtagttggtagctttttgatggattggatgaccaaaacacttttatttatccacccgttactttttattgttctagtaacagcagggatgtttttccttgctaagaaaaaatggcctttgccaacctttaccttgttaggattgctctttatttacaatcaagggttatggaagcagctaatgaatacctttactctggtgttagtagctagtttgatttcggtacttattggtattccgctggggatttggatggctaaaaatgccactgtccgtcagattgtgaatcctattttggactttatgcaaaccatgccggcttttgtttacttgattcctgccgttgccttttttggtattggtatggtgcctggagtatttgcttcagtcatctttgccttaccaccaacggttcgtttcacaaatttggccattcgtgacattccaacagaattgattgaggcctcagatgcctttgggtcaactgggaaacaaaagctctttaaagtggaattgcctttagctaaaaatactattatggcaggtgttaatcagaccatgatgttagccctttccatggtagtaacaggctccatgattggtgctcctggtttaggacgtgaagtcttgtcagcccttcaacacgctgatattggtagtggatttgtcagtggtcttgccttggttatcttggcgattgtgcttgaccgtatgacacagttgttcaatagcaaacctcaagaaaaagccaaagctggcaaaaccaataaatggattggtttagcagcccttgctgtctttttgatagctgctttaggacgcggtattatggctatgacttctggtatggcagataagggtgaaactgttaacatcgcttacgtgcagtgggattctgaggttgcctcaactcatgtgattgcagaagttttgaaaaacgaaggttaccatgtgaccttgactccgcttgacaatgccgttatgtggcaaaccgttgcaaatgggaacgctgatttttcaactagtgcttggttgccagtcacccatggccaacaatatcagaaatacaagtcaaaattagatgatttaggacctaacctaaaagggaccaaacttggtttagctgttccaaaatacatgacagatgtcaatagtattgaggacttaagcaaacaagccgatcaaaaaatcacagggatcgaaccaggtgcaggtatcatggcagcagcccaaaagactctaaaagagtatcataatctatctagttgggagttagtggcggcatcaacaggagccatgacgacttccttggatcaagcgatcaagaaaaaagatcctattgttgtgacagcttggtcaccacactggatgtttgccaagtatgacttgaagtaccttaaagatcctaaagaaatctttggctcgactgagaacatcaataccattgctcgtaaaggcttgaaaaaagaacttccaaatgtctacaaaatcattgataagttccactggacccaaaaagatatggaagcagtcatgcttgacatcaacaaaggcatgagtccagaagctgccgccaaaaaatgggtagaggcaaacaaatctaaagtatcaagttggacaaaa

SEQ ID NO: 827 - DNA, 1308 bp, Streptococcus pyogenes
atgattcatttaataataattagcgccattgctctagccattggaattggttaccgcaccaaaatcaatattggcctgctggctattgctttttcttacctcatcgcaaccactctcatgggattaagccccaaagaacttcttcatttttggccaacctcactcttttttaccatttttagcgtctctctcttttataacgttgcaacaactaacggcactcttgatgttttggctcaacacattctctaccgcacacgcacccaccctaacgccctctacatgattttatacctgatagcaacccttttgtctgctttaggtgctggatttttcactactatggccgtttgctgtcctctagcgattaccctctgtcaaaaagcggacaaacaccctttgattggagctcaagccgtcaattggggagcttcaggaggggctaatttgataaccagtggctcaggcattgtctttcaaggcctgtttaagcaaatgggatgggaagagcaagctttttcacttggcaatcatatctttatcgtcagcattatctacccactcatcgtcttgcttttattatcttgttacatccgctacagtaagggaagaacaaactcatccttgactattgaccaaccaccagtcctcagcaaggtccaaagacaaaccaccttgctcatgatcagcagcatggttttggtttggctttttcccttgttgcttctcattttcccaaacatcgcatggatagctacttatcgacaaacatttgatattggctttgtctcaatactcatggtctgcctcgccttaaggctcaaattagggaagcaagaagccattttggctaaggttccctgggctataattatcatgctctgcggtatgagcttactaatgtctctagcggtcaagtcaggtttagttacactgatagggcacctcataacaacaaccattcctcatttctggttacctctgttcttttgtgtgatagccggagtgatgtcactctttagttccaccctatccgtcgtagccccaactctctttcccatcattgctaccatcagtgctcaaagtcctcacattgatattcgcttactcacaacagccactattattggcgctctatctactaatatctctcctttttcatcagctggttccctcattcaactctcccttccccatatagaggaacgcagtcttgctttcaaaaaacaaattcttctgggtgtgcccatcagcttaagtttggcactcttgaccatctggattctcatgctgctagcttccttaagt

SEQ ID NO: 828 - DNA, 699 bp, Streptococcus pyogenes
atgatattgctgtttaggaggtttatcttagatgacacagttattaaaacgatatcctattactattttccttttagggttaacaggcttaatttttatagcaatgcaagtggtatatggacatttagcaactggtgctcaagctatttatcaagttggaggtatgtttggattactagtaaaagcaatgccagaccagttgtggcgattggtgactccgatatttattcatatcggctttggtcatttttttgtcaatggattaacactatattttgttggtcaaatcgtcgaagacctctggggctcacgccttttttattactttatgttttatcaggtgttatgggcaatgcctttactttttggttgactcctgaaacagtagctgcaggagcatcgacgtcgttatttggactttttgctgctattgtagtattgagttttttgggtaagaaccaagcgttgaaagatttgggcaagtcataccagacgttaattgtagtcaatttactgatgaatctttttatgccaaacgtgagtatggcaggccatattggcggtgtcgtgggtggtgcgttactgagtatagtttttccaactaagatgagagtgataacagtgaagaaaaccaagcgaatgttggctttagtgagctatggtattattttggttggtgtgttagtgcttgggttttta

SEQ ID NO: 829 - DNA, 1584 bp, Streptococcus pyogenes
ttgaaacaggagacctatatgaaaaagctaatccttagctgtttggtcgccttggcccttctgtttggaggaatgagccgggctcaagcaaaccaatatttaagagtcggaatggaagcagcctatgctccttttaactggactcaagatgacgcttcaaacggggctgttccaattgaaggaactagccaatacgccaacggttacgatgtccaagtcgctaaaaaagtcgctaaagctatgaacaaagaacttttagtcgttaagacctcttggaccggtttaattccagcattaacttctggaaaaatcgatatgatcgctgctggtatgagtcctaccaaagagcgtagaaacgaaattagcttctcaaacagctcctacactagccaacctgttctagtcgtaactgccaatggcaaatatgctgatgcaacaagcctcaaggatttttctggagctaaagtaactgcccagcaaggcgtttggcatgtcaatctcttaactcaactaaaaggtgctaagttacaaacaccaatgggagatttctctcaaatgcgacaagcccttacttcgggtgttatcgatgcctatatttctgaacgacctgaagccatgactgctgaagctgctgatagccgtttgaaaatgatcactcttaaaaaagggtttgctgttgctgaatcagatgctgctatcgctgtcggaatgaaaaaaaatgacgatcgtatggcaactgtcaaccaagtgcttgaaggattttctcaaacagatcgtatggccctgatggatgatatggttaccaaacaacccgtggaaaagaaagccgaagatgctaaagcatcatttctaggccaaatgtgggctatttttaaaggtaactggaagcaattcttacgtggaactggaatgacccttctgatttccatggtcggaaccattacaggtctctttattggattattaatcggtattttccgtacagctcctaaagctaagcataaagtagctgccttgggacaaaaactctttggttggttactcactatttatatcgaaatcttccgtgggacacctatgattgttcaatctatggttatctactacggaacagcgcaagcctttggtatttcgatcgaccgtaccctagcggctatttttatcgtatctatcaatacgggggcctatatgagtgaaattgttcgcgggggtattttcgctgtcgacaaaggtcaattcaaagcagcaactgctcttggctttactcacggacaaaccatgcgtaaaatcgtgctaccacaagttgttcgcaacattttaccagcaacaggtaatgagtttgtcatcaatatcaaagatacttctgtcttgaatgttatctctgttgtggaactttacttctcaggtaataccgtagccacacaaacctaccaatatttccaaacctttacgattatcgccattatctactttgttcttaccttcacggtgacacgtatccttcgttatattgaacgccgtttcgatgccgatacttacaccactggagcaaaccaaatgcagattgcggaggtctcaaatgtc

SEQ ID NO: 830 - DNA, 1896 bp, Streptococcus pyogenes
atgaaaaaaattttgatgacgcttgtgctctgcttcagtcttttagggatacgaataaaagcagctgatgtagactatagcatcaccaactatgaaggtcagttactgttatcaaaagaaaatactgctcggtttgagcaaaaagtaacctatcaatttgacacttcttataacggccagtatatttcgctgggccggacaggtcatttgccagcgggctttgctattgaccaaaagcctaaagttgaggtatatcagaatggtcaacaggtacctgttagtcaagagtttagtgaccttggagatggctatcgtttaaaactttataatgctggccaagctggtgataaggttgacgtcaaggttatctggcaactgcaccaccttttaacagcttatcaagacgtggcagagctgaattggacaccgattagtgattgggacaaaacattagaaaaggtgagtttgaccgtcactaccccaactgatattcaggattctaatctatgggctcacagaggatattaccaaaagaaacctcaagtgttaaaagaaggtaacagtcgctatcagattaatgccaagaatgtctcagggcaactggaattgcatgcttattgggataaaaaagcattattgggaaaagagccagttgatgtttcaacgagtaaaaagaataaaattgtagcgttagaaactaagatttccagacgaaggaccttgttacagctgctatttggcaaagtcattcctctggtagaggtaggttttcttctttggcagttaatacagtttacaagattaaagaaacaattcaatcgttatcatttggctaaccatacagatcacagttacgaagtccctgaagatctttcgcctcttgtgttgacacaagcgatttatggacagagttttgcctatttatcccctacagcatcagaaagccagaaattattgatccctaaaggagtgacctttgaggcccttgttcaagctaccttgttggatctgatcgaccaaaaggtgcttttattaacgaaagaagaagggaaagcttatcttgaaatcagtcagttagatcgtgtgacagatgaggaagctgccttcttagatatggcttttggaaacaaggtgacattgccggtggatcaattgtttagtcaataccattatgatgctgataccattaaacaattaaagaaaacgtacaaaggtaaaaagctcgagcaagaagtccgtcaatcgtctgagcaggtgattaaggcgatgaaaaaagcgtcggcagctattacaaacaatgtcctagaaactatcaaaaagttaaacttaccagatacttatcgtcaaatgaccccggcagagaaacgaaaaagcaatagtgtccagggattaggttgtttgttgcttattctaaatagtggtttattgatttacttggctattaaagaaagtgggttagccctcatttaccttgctttaatggtgctaacgatgtgccttggcttttacattagcctgaagttagatcaatacaagaaattgggtattgaaacacctgaggggggtgttcggttacatcaatggcagagctttaaaaacatgatacgagacattgacaaatttgaggatgttgctattgaaggtttggttgtttggaaccgtgttttggtttatgccaccttatttggttacgctaagaaagtggaacgctatttgaaagtccatcgtattgccttacctgaggtttaccaagctgttcgaccaggtgaattatcaatggtaatgtatgctacgacaccaacctttgtgtctagcttgtcttcagctacaacttcctcaaatttctcagtctcttccggaggcgggattagtggtggtggcggcggcggtgccttt

SEQ ID NO: 831 - DNA, 1512 bp, Streptococcus pyogenes
ttgaggacaactatgaaaaaatatattttaaaccgtatcatgcgatcgttagtgtcggtagttctggtaacggctttaacatacaccatcgtatatactctagtacctaccagccttatctttaaacaagaccctaattataataaaatgacaacaacaccagataaaaaagtagcgtatgaaaatctaacttttcaacgtatgggttatgtcaattatttttcaagcaaagaattaaaagataatgcttctaaagtagatagtagtgtaacgacagaagcaactagtgctaacaaagctatctatgagaagtatattgattctcttggcaatggctggcagctaaaacgcttccccactagcaaacagttttatgcaattcgcaatattcctatttacgaacgtgtttggaactttttctcaaatctagttgttattgatcacccttggaagattcaggataaagataatccaaaattagctaggtatattcgtctagaaaaagataaatcagttggctggtcacttgttggttcggggacaaaacataagtatctcctctatactaacggaaaatttccttatcttcaccaaaactttgttaccttaaacttagggacatcttatccaacatacagcaatattcctgttcttcaggtcatttcacaagggcaaggacgaacagctcttcaagatgtgaccttcccatcaggtgtcactaagaaatcgtcagtggatatctatagccgtagctacaaaaatccaaaatcattggatgatatcaccaaggtaaactatggtaagggagattcctacactaaaaccatcaataattatgtcgacccatcaatgattcacaattcttttgtaattggtttttttggtgttatgttttcctatatcgttggtttgcctcttggtttatttatggctcggtttaaaaatacctattttgacagtttctcaacagcgaccatgaccttcatgcttgctttaccaagtattgctgttatctatgttgttcgcttcctaggtggcatggttggtttaccagatagtttcccaatgctgggggcatctgatcctaaatcttatattttaccagcccttattttaggaattttaaatattccaactacggttatctggttccgtcgctatcttgttgaccttcaggccagcgattgggtacgttttgcgcgttcaaaaggattatcagaatctgaaatttacagagggcatctcttcaaaaatgccatggtcccaattgtgtcaggggttcctgcaagtattatccttgctattggtggtgcaacattaacagagactgtctttgccttcccgggtatgggtaaaatgttaattgattctattaaatctgctaacaattctatgattgttggattaacctttatcttcactgtcttgtcaattgtttcacttttactaggagatattgtcatgacccttgtcgatccacgtattaaattgtcaacaaaaaaaggaggtaag

SEQ ID NO: 832 - DNA, 924 bp, Streptococcus pyogenes
atggaatcgattgataaatctaaatttcgatttgttgagcgcgatagtgaagcctccgaagtgattgatacccctgcttattcttactggaaatcagtgtttcgtcagtttttttctaaaaaatctacagtctttatgctcgtaattttagtgacagtcttgatgatgagctttatttatccaatgtttgccaactacgactttaatgacgttagtaatatcaatgacttttcaaagcgttatatttggccaaatgcagagtactggtttggaaccgacaaaaatgggcaatctctgtttgatggtgtttggtatggggcacgtaattctattttaatctcagttatagcgacactaattaatatcaccattggggtagtgttaggagccatatggggagtttctaaagcatttgataaagttatgattgaaatttataacattatctcaaatatcccttctatgcttattatcattgttttgacctattcattaggtgcaggattttggaatttgattctagctttctgtatcactggatggattggtgtcgcctactccatccgtgttcaaatcttgcgttaccgtgatttagaatacaaccttgctagtcaaactttgggaacaccaatgtacaagattgctgttaagaacctcctgcctcaattggtttcagttatcatgactatgttgtcacaaatgctaccagtttatgtatcttctgaggccttcttatccttctttgggattggtttaccaaccaccactccaagtttaggacgttttattgctaattattcaagcaacttaacaacaaatgcctacctcttttggattcccttagtaacattgattttagtatcgttaccactatacattgtcggacaaaacttggctgatgccagtgacccacgttcacataga

SEQ ID NO: 833 - DNA, 660 bp, Streptococcus pyogenes
atgtttatgaactcggatggtcatggagatgcaggttggggcttagcgatttggaatactttatacatgaccattgtgccttttattgttgggggggctattggtctcttattaggcttgttattagttttaacaggaccggacggtgttattgaaaacaaaacgatttgttgggttattgataaagttacctctatttttagagccattccttttgttattttgattgctattttagctagctttacctatttgcttttaagaacaactttaggagcaacagcggccttggtacctttaacctttgcgacttttcctttttatgcccgtcaggtccaagttgttttttcagaattagacaagggtgttattgaagcagcacaagcttcaggtgctactttctgggatattgtcaaagtgtatctcagtgaaggtttaccagatcttattcgtgtttctacagtcaccttaatttctttagttggggaaactgccatggcaggagctatcggtgctggaggattaggaaatgtagcgatttcttatggttataatcgttttaacaatgatgtgacttgggtagcgactattattattcttttaattatttttgctatccaatttattggtgatagcttgactagaaggtttagtcataaa

SEQ ID NO: 834 - DNA, 783 bp, Streptococcus pyogenes
atggcaaaattgagatgtatgcacgctatttttatcaaacaatacctcaaacaaattatggaatacaaggttgattttgtggtgggagtgctaggtgtttttctcactcagggacttaatctgctctttttatcggtacttttccaacatatcccttctttagaaggctggacgtttgaacaaattgcctttatttatggcttttgtttgattccaaagggaattgatcacctcttttttgacaatctttgggctttagggcaacggcttgtccgcaaaggagaatttgacaagtacctcaccagaccaattagtcctttgtttcatgttttagttgagacctttcaagtggatgccctgggtgaattattggttggggttatcttattagtgaccacggctggtagtatcgtatggactcttcctaaggtgcttttgtttattttggttattccttttgcgaccttgatttacacctctttaaaaattgcgaccgccagcatttctttttggaccaagcagtctggggcagttatctatattttttacatgttcaatgacttttctaagtaccctatgtccatttaccattcctttttgcggtggttaatcagttttatcattccctttgcttttacagcttattaccctgcttcttattttttaacaggtcaacacctgctctttaatattggaggcttggtagtggtgtcgttactggttttggccttgtcgcttaagctttggaaatggggcctggatgcttatgaaagtgcaggttcc

SEQ ID NO: 835 - DNA, 1860 bp, Streptococcus pyogenes
atgacgtatcaagaaactgccaaggctattttagcggcggttggtggcaaaacaaatattcaacgtgtgacacactgtgtaacacgtctacgcttagtactgaaaaatgatgagaaagttaaagatcagcaagtcaaagccatttcaaatgtgattggcgtgatgcgcaaaaacggccagtaccaaattatcttgggcaatgatgtcaataattattaccaagcctttttaagcctagggcattttgacaatcaagatgaagatcattcttcaaaagcgaaaggaagtatccttgagcgcttgattgaaaccattgctggcgtgattacaccgctgattccagcccttcttggtggtggaatgctcaaagtggtgggaatcttgcttcctatgcttggcttagcgagtgcggactctcaaaccgttgcctttattaacttctttggcgatgcggcttattattttatgcctgtcatgattgcctattcagcagcggcgcgctttaaggtgacacctgttttagcagcgacgatcgcagggattttattgcatcctgcctttgttgcaatggtagcagaaggtaaaccattgactttatttggagcaccagtcactcctgctagctatggctcatctgttattcccattttgatgatggtttacttgatgcaatacattgaaaaatgggtcaatcgcttggtgccaagcgtgatgaaaagcttcttacagccaaccttaatcattttgatttctggctttttggctttagtggttgtaggtcctcttggtgtgattattggtcaagggttatctaataccatgctcgctatttatcatgtggctccgtggctagcacttgctattttgggagcgattatgccgcttgttgtcatgacggggatgcactgggcttttgcaccaatctttttggccgcttcggtcgcaacaccagatgtcttgattttaccagcaatgttggcttctaatttggctcaaggagccgcatctttggctgttgcctttaaaacaaagcagaaacaaacacgtcaagttgcccttgccgcggggatttcagctttgctggcaggtatcacggaaccggcactttatggggtcacactgaaatttaaaaagccactctatgcagccatgatttcaggtggtctggttggagcctttattggttttgtcaatattgcttcttatacctttgtcgtaccttctattattggtttaccacagtacatcaacccatcaggcggagctaattttacaaatgctttgattgccggaactgcgacgattgtgttagccttcagtttgacttggttcatgggaattgatgaagagtccccaaagcaagtgagtgttgcagcagatatgtcacaagttaagagcggcttgtcaaccaaacaaacgttgtatgctccaatgacaggtgagatgctttttctatcagaagttcctgatgaaaccttttcttccaagttattaggagaaggatttgccatattaccaagcgaaggtgaggtctatgccccctttgatggtgaagtcatcactttctttccaaccaagcatgctgttgccttaaaaaacacacgtggtgtggaagtcttgattcatgtcggtattgatacggttgagttaaaagggcaaggtttcgagcagttagtgtctgttggcgatgtcgtgaaacgaggccaggcacttctaaaaatggatattgatttcattacttcaaaaggctattcactcatcagtcctgtggtcgtgaccaattcggctgagcagttggagattattattcaagatgacaaaaaaatggtgactaaagaggacgctttgttagtcatttta

SEQ ID NO: 836 - DNA, 900 bp, Streptococcus pyogenes
atgtcactcttttccaaccttcctcccagtgtcttgcaatggtttgcgatttttatgtccattatcattgaagctcttccttttgtgctcctaggaactattttatctggttgtattgaagtctttgtaacgccagaattggttcaaaaatacctacctaagcaaaaatgcttgcgcattctgtttggaacctttgttggatttgtttttccttcttgtgaatgcgggattattcccatcatcaaccgctttttggaaaaaaaggtgcctagttatacggccgtcccttttctggcaacagcgcctatcattaatcctattgttttgttcgctacttattctgcttttgggaattctttgcgctttctgatacttcgcttggtcggtgctgcactagtagccattacacttggggtaatgttagcttttattgtagatgataacattctcaaggataatgctcaacccgtgcattttcatgattattctcatgaaagcttgccaaaacgcatttatctagcactggtacatgctattgatgaattcttcgacaccggtaggtatctcgtatttggaaccttgattgcctctgccatgcaaatatatgtcccaactcgtgtgttgacaacgattgggcacaatcccttgacagccattttgatcatgatgctgatggctttcattctatcattatgtagtgaagccgatgcctttatcggagcttccttattatccacctttggagtggctccagttcttgcctttcttttaattggtcctatggtggatattaaaaaccttatgatgatggtaaaggcttttaaaggacgcttcattgtccaatttatcggcgtatccgttcttatgattgccgtttattgtttacttgtgggggtgctc

SEQ ID NO: 837 - DNA, 1302 bp, Streptococcus pyogenes
atgattatctcaagaagtagagggaaaactatgaagattgataaaaggcacctcttaaattattctatattattgccttatttaattttatcggtgataggcttaataatggtttactcaaccacaagtgtcagcttgattcaagcacatgctaatccatttaaatcggtgattaaccagggagttttttggataataagtctagtggctattacatttatctataaattaaaattaaattttttaacgaatacaagggtattaactgtggttatgttaggagaggcctttcttttaatcattgcccgcttctttacaactgctatcaaaggagcgcatggttggattgtgatcggaccagtcagctttcagcctgctgagtatttaaagatcattatggtatggtatttggcattgacctttgctaagatccaaaaaaacattagcctttatgattatcaagcactaactcgtcgaaaatggtggccaacacaatggaacgatttacgggactggcgtgtttattctttgttgatggtacttttggttgctgctcagcctgacttgggaaatgcttccattattgtattgacagccattattatgttttctatcagtggcattggttaccgatggttttcggctatcctagtcatgattaccggtctatccacggtctttcttgggactattgccgttattggggtagaaagagttgctaagattcctgtttttggctatgtcgctaaacgttttagtgccttttttaatccttttcatgacttgaccgattcaggtcaccaattagccaattcttactatgctatgagtaatggtgggtggtttggccaagggttaggaaattccattgaaaagcgtggctatttgcccgaagcacagacagactttgtcttttcagttgtcattgaagagttaggtctaataggagcagggtttattttggcacttgttttcttcttaattttacgtattatgaatgttggtattaaagcaaaaaatccttttaatgccatgatggctttaggagtaggcggtatgatgctcatgcaagtctttgttaatattggtggtatctcaggcttaattccatctactggtgttaccttcccttttttgtctcaaggtggaaatagcttacttgtcttatctgttgcagtgggttttgtactaaatattgatgctagcgaaaagcgagatgatatatttaaagaagctgaattatcttatcgaaaggacactcgaaaagaaaatagtaaagttgtaaatatcaagcaatttcaa

SEQ ID NO: 838 - DNA, 957 bp, Streptococcus pyogenes
gtgatgaagaaaaaggagattatggttacgatgattagatactttttccgtcatatttgggaatccattaaaaatcttaaacgcaacttttggatgacatttgcttcagttagtatggtggctgttacattgactttagttggtgtttttgcggcgacattgttgaatatacagcgtgttgcttcgggtgttgaaaataatgtccatatcaatacctacttacaagttgattcaactgatgctgcaaaagttattcaaaatactgccggtgaacctgttaataacgataactaccacagtgtttacgacaaaattgctcagataaaaggtgtcaaaaagattacattttctagcaaggatgaacaattgaaaaaattgcaagaaaccttaggtgatgtttggaatatgtatgaccaagacactaatccgctccaagatatctatcttattgagacccagacgcctaaacaagttaaggcgatcactaaaaagatcagaacgattgaaggcgtagaagccgcagattatggagggattaactccgataaactatttaagttttcaacattaattcaaacttgggggctgatcggaacagcaatgctattatttgtagctgtctttctcatttcaaacactattcgtatgactattatgtctcgtaaacgtgacattgaaattatgcggttagttggtgctaaaaattcttatattcgagggcctttcttttttgaaggggcttgggttggcttgttaggagctgttttaccatctcttctgatttattatggatatgatcttgtttataagcattttgcacaagaattacaacgtaataatctctcgatgtatccgcttgatccttatgtatattacctgattggtgctttgtttgtcataggtattatgattggttcgcttggttcagtgctttctatgagacgttatttaaaattc

SEQ ID NO: 839 - DNA, 1074 bp, Streptococcus pyogenes
atgtttttagcgcttaatgaaatgaaacaatccaaattgcggtatggtttgattgctggtttgctatgtttggttgcctatttgatgttctttttgtcaggattggcctttggtttgatgcaggagaaccgctcggcggttgatctttggaaagctgacagtgttttactagccaaggatgctgacgctaccttgaccttatcacaggtgtccagagctcaagaaaatcaaataacagcagacaaggtagctcctcttgctcaactcaataccgtggcgtggtcagttaaaaatcctaaggatgccgacaaagttaaggttagccttttcgggattgattctaatagctttattcgtcctaacattgtaaaaggtcgattatttaagactaacaaagaggttgttttggatcaaagccttgcaaaagaggaagcttttgcgattggcaaggacttttacacatcgagttctagtcaagcattaactatcgttggttatactcaaaatgctagatttagtgttgcaccagtggtttatatgaatttggaagcttttgaaacattaaaatatggagaaccactaccaaaagataagcaagttgttaatgcttttatcactaaaggaagtttaacagattatcctaaaaaagacttccaaaaattagatattaaaacctttattactaaattacctggttatagcgctcaacttttaacttttggctttatgattagttttcttgtcattatttcagctattattattggtatttttatgtatattttgactattcaaaaggcacctatttttgggattatgaaagcgcaaggaatttctaacaaaacgattacgaccgctgtgcttatgcagacattctttttgagttttttaggtagtggtttagggttgctaggtacttggctgacatcattattattaccaacagtagtaccttttcaaagcaattggtttttgtatttggctatattcgttagtatgatctgttttgctctattaggcaccttattttctgtttttaacattatacgaattgatcctttgaaagcaattgga

SEQ ID NO: 840 - DNA, 2472 bp, Streptococcus pyogenes
atgattaaagacacatttttaaaaaccaattggttaaatattagtcaccatattatccttcttgttttcggtttttatttcagtttttacagtttggcgaaagaactagtaagctccacggcacaaccggtaaactattatgctcatttactaaatgtttcttttgtgggatatattatatcactgattggattatcttattatttgagtcgccaagttagtcgacagttgtttttgaaaactagttttattgtgatatcttatctaattgtcagctattgggtacaaataacacagcacctgaatgataaacggtttgatatctggtcattaactaaaaatcaattttatcaatttcaagctctaccttctttactcattattttagtgatggccactttaataaaaatattggcagcatattttgcaatagaaaaagatagatttgggctattaggctatcaaggtaatactttttctgtagctctgattttagcagttgtgccaattaatgacatacatctgttaaaactaataagttctcgattttctgaattagtaacagcaggtaatagccaaattgcactgttaaaaataagtggactgttgatagttttacttgtcatatttgcaacaatcatatacgtggttttaaatgctctaaaacaccttaagtcaaataaaccttcattttcagtagcagctactactagtttgtttttagcattagtttttaactatacgttccagtatggagtaaaaggtgatgaagcattgctaggatattatgttttccctggagctactctttttcagatagtagctattacactagttgctcttttagcatacgtgataacgaatagatattggccaactaccttctttttgcttattctgggaacaattatttctgttgttaatgatttaaaagaatcaatgagaagcgagccgttattagtaactgattttgtttggttacaagaattaggtttagtgacaagctttgttaaaaaatcggtgattgtagaaatggttgtaggacttgctatttgtattgtggtagcttggtatctacatggccgagttttagcagggaaattatttatgagccctgtcaaacgggcaagtgctgtattaggtttatttattgtatcttgtagtatgttaataccattttcttatgaaaaagaaggtaaaatattatctggtcttccgattatttcggctttaaataatgataatgacataaactggttaggtttttcaacaaatgctaggtacaaatctttagcatatgtttggacaagacaggtgaccaagaaaataatggaaaaaccgacaaattatagccaagaaacaatagcgagtatcgctcagaagtaccaaaaattagcagaagatattaataaagacagaaaaaataatattgctgaccaaacggttatttatcttttaagtgaaagcttgtcagatcctgatagagtatcaaatgttactgttagccacgatgttttacctaatatcaaggcaatcaaaaatagcacaactgcgggactcatgcagtcagactcctacgggggtggaacggctaacatggagtttcaaacgttaacaagcttacctttttataatttttcttcttcagtatctgttctttattcagaagtctttcctaaaatggccaaacctcatacgattagtgagttttaccaaggaaaaaatcgtattgcgatgcatcctgctagtgctaacaattttaatagaaaaacagtttatagtaatttaggtttttccaaattcttagctctatcgggttctaaggataagtttaagaacattgaaaatgtcggtttattgactagcgataaaactgtctataataatattttatctttaattaatcctagtgaaagccaatttttctcagttattacaatgcaaaatcatattccttggtcatccgattatcctgaagaaattgttgctgaaggaaaaaatttcacggaagaagaaaatcacaacctaacaagttatgctcggttattatcgtttactgataaggaaacaagagcatttttagaaaaattaacacaaattaacaagcctatcacagtggtgttttacggagatcatttacccggtttatatcctgatagtgcttttaacaagcatattgaaaataaataccttactgattattttatttggagtaatggtactaacgagaaaaaaaatcatccgcttatcaactcaagtgattttactgcagctttatttgagcatactgattcaaaagtatcaccttactatgctttgttaacagaggtactgaataaagctagtgtcgataaatcaccagatagtcctgaagttaaagctattcagaatgatttaaaaaatatccaatacgatgtgactataggaaaaggttaccttttgaaacacaaaactttttttaagatatcacgt

SEQ ID NO: 841 - DNA, 1284 bp, Streptococcus pyogenes
atgattaatccttcaaaacaaaaccaaacgatttttttatggaatatgttaggaagtttatcaacagctgtaatatcagttatattacttatggtggttactaggttactaacttcggctgattcagatatttacgcctttgcctattcttttgctaatatgatggtagttgttggactttttcaggttcgtaattatcaagcaacagatattaatgaaaaatattcctttagtcagtacttagtggcaagactgatgacttgtttattaatgttagccataacagtaatttatttaacgttaactaagacagatagctacaagagtacaattgtctttctagtctgtttctatagatcgacagatgctttttcggatttatatcagggaatgttccaacaacatgaacggctggatattgcaggtaaatcgctagcctacagaaatactcttatttttatggtgtacacagcaataatattatattccaaaaatcttactttagcattagtagctgtctgtatagtttcattagtttttataatgtattatgacattggtcattcgaaaaaatttcaaaagttgatgtttagtgaattattaagtaatatttcatttcaaaacagtttaaagttattaaaagaaagttttccactttttctaaacggttttttgattatctatatttatactcaaccaaaatacgctattgaactaatgacgactttaggtgaagttgctttgggctctcaaacaatttttaatattttatttatgccagcctttgttatgaatttgctaattttattttttagacctcatattacacagatggctattgctttaatcagaggtcaaataaaagagtttaataagatacaagttcaattgtttgcttatttaggagttttttcactgatagcgttagttggaagtggtttgtttggtattccctttttatcaatactatatggtactaaccttacggattattgggtagattttatgttgattatgctaggaggctcgattggtagttttgcgacagttatcgataatatcttaaccgctatgagaaaacagcaacttcttcttattccatatacaggaggatttttgatttcgttattaattaccaatctttttgttatgaaatatcatattttaggagctgctttgagctttttaataacaatgttggtttggttgggattatccattatgatttatctatttattatgaatagatttaagaagggaagagttaatgcaacaatctatgac

SEQ ID NO: 842 - DNA, 1494 bp, Streptococcus pyogenes
atgcaacaatctatgactaaagttaaatatctttggaaagaaaataataactatatttattcgacttttttgacattacttctgacagttattttatatgccaatagtttaaatctacctttaaaatttattagtcttctttttgtggtgagcactttactgatagtgtttttaccaaaaaagttagaggttgctacgatcatttttattttagtatttggaacgatatctgctatcatatcacctataaatgatattcctgatgaatatgttcattattcaaggacagtttatatctcagaaggtgatattaatcttaccaacaataacaaaaagttaagaatatccaaagatgttgataagcttattaaacagtcaggaaaaacatttataacatcaaacttgaaagcaactaaacacagcacaagagagtatagctatccttacatcaaaggaactaatgcatattatagtttttcttatataccacaagctttgggtattttagtaggaaatgcgctggatttacctatacttttaacatattatttcggaagattgtgcaaccttattagctacgctatgcttgcttttatagctatcaagttgtctggttcttttaaacaagtgatagctgttgttactttactacctatgaacatttatttagcagcatcttttaatcaagacggctttgctatcggtttagttttagtaacaattggattgtttattaacttgctctcatcaaaagataaatctaactataataccaaattcttcctttatttagttctatgtgggttactagttctttcaaaattcacatactttttattagtatgccttccattatttattcctaatgaaaaattcggaaaaaataccaagttagtcatcttgaaaaaattgggaggactattactcatttttctttttgctgcaatgtggtttagactttatggacaggttaaaaccccatatgtcgcggattttctaaaagaagtaaacgttagccagcaagttaaaaatatgctagaatcccctatagtctatagcagtattattattagacatatggtaattaatctgattaatatgaataatatttttcagtttggcgcattaagctatggtataacgaaccttttcccgctttatgtgtgtttcttcttttttgtttatattagtaatgctagtaaaataactattaatattgtagaaaaaatgggtataatctttgttatttcagcgattataggtgcaactgtattagctatgtacctgacttggacaccagtagggtcctcaactgtcttaggtgttcaaagtcgttatctgataggaattatcccattagtgttgcttctttttagtagtcaacagcaaaagttcaaacaaatagaggatatcctttctgacaaactggctattcatgtttcgcttttgtttattcttgcaatgttaatgagtactatttttagatattatcat

SEQ ID NO: 843 - DNA, 1218 bp, Streptococcus pyogenes
atggaaaattggaaattcgctcttagctcaatttgggggcataagatgcgctcaatcctgacaatgttgggaattatcatcggtgtagcagcagttgtgattattatggggttgggaaatgctatgaaaaatagtgtaacaagcacattttctagcaagcaaaaagatattcaactctattttcaagaaaaaggagaagaagaagacctgtatgccggattgcacacgcatgaaaataatcacgaagtgaagccagagtggttagaacaaattgttaaagatatcgatggtattgattcttattactttaccaattctgctacttctactatttcgtatgaaaaaaagaaagtagacaatgcttcgatcataggggtaagtaaagattattttaatataaaaaactatgatatcgtagctggtcgtacactaacagataatgattattctaatttttcgcgtatcattcttttagatacagtattagccgatgacctatttggcaaaggtaattataagtcagctttaaataaagtggtaagtttatctgataaagattatttagttattggtgtttataaaactgatcagacgccagtttcttttgatggattatcaggcggcgctgtcatggcgaatactcaggtagcttcagagtttggcaccaaagaaataggatctatctacattcatgtgaacgatattcaaaacagtatgaacttaggaaatcaagcagctgatatgctaaccaacatatcgcatattaaagatggacagtacgctgtccctgataatagcaaaatcgttgaagaaatcaatagtcagttcagtatcatgacaacagtcataggttcaattgcagcgatctctcttttagtgggaggaattggtgttatgaatattatgttggtatctgtcacagagcgaactagagaaattggtttacgtaaagcacttggtgcaacacgcctgaaaattttatcacaatttttgattgaatccgttgttctaacagttcttggaggcttgataggattattattagctcaattaagtgtaggggctttaggaaatgcgatgacattaaaaggagcttgtatttctcttgatgtggccttaatagcagttttattttctgcctcaataggtgtcttttttggaatgttgccagctaataaagctagtaagttagatccaattgaggcattacgttatgaa

SEQ ID NO: 844 - DNA, 1773 bp, Streptococcus pyogenes
ttgtcaggcaatgagttgtttaaaataaaggagattagttcaatgacatttttatctgatttgatatcattaatgacaaaaatcagattatcttgggtaataaaggcgggtatttttcaattattatttgtaacgattgctaatattgtcttatcagaatttttctattttatattagacgttactggtcaatatcatttagataaagacaatgttgtgacttttttaaaaaatcctatagcacttgctttattaggtgcctatttatttttattagctgcttttattcaccttgagttttttgctctatatcgaattattgcggatcaagaaattagtttctatctttttagaaaacagttttcttattacctaagggggctttggaaaacattttctggttaccaattattactttttttgctttatatcctattgactattccagtcttacatattggtttatcttctgtgattactcaaaagctttatcttccagaatttattgttggggaattatcaaagataactagcacaaagtacttgctttatggcagtcttattcttgtgttttaccttaacctaagattagtatattttttaccattgatagcaatcaaccatcgtacggttgctcaagcatggagagagagttggcaaaagactaaaaagaaacatgtattgttatggatgaaactttttgcaatcaatggtcttacgattgtagtcttatcgctagctatttccatgattcttatttttgttgatatgtttaatcctaaggggaataatattattgttcagctgggagctttgacctttacatgggaactcattttttttactactattttttttaaactctgttcagcaatgattttaaaagaggcaattgaaccacaaaagcaatatgatgagccaagaagaagtaataaggcatatgttgtaatctttatcgtggttacagtaggttttgcttatcaatctcttgaacgtttaactttttttgacacatctcactctaagacagttatcgcgcatagaggacttgtatcagcaggtgtagaaaattctctggaagcccttgaaggtgctaagaaagcaggaagtgattatgtagaactggatctaatcttgactaaggataatcactttgtggtgtctcatgataatcgattgaagcgtttagctggagtaaataagacgattcgcaacttaaccttaaaagaagttgaacatctaacgagtcatcaaggacatttttcagggcgttttgtttcttttgacactttttatcaaaaggctaagaagttgaatatgccattacttattgaactcaagccaattggtacagaacctggaaattatgtcgatttgtttttagaaacttatcatcgacttggtataagcaaagataataaagtcatgtctttagatttagaagtaatagaagctatcaagaaaaaaaatccatcaattacgactggttatatcataccaattcaatttggattttttggagatgaatttgttgatttctatgtcattgaagacttttcttatcggtcttatttgtcgtcccaagctttttggaataataaagaaatttacgtttggactattaatgatcccaagcgcatagagcattatctcctaaagcctattcagggaattattacagaccaaccagctttaactaatcaattgattaaagacttaaaacaagataattcttattttagtcgattagtcagaattattagtagtctttat

SEQ ID NO: 845 - DNA, 849 bp, Streptococcus pyogenes
atgaataatttatctagtatcgatattaaatttttattaagcttatttgcggatccttggctgctggcagtgcatcttttagatattctaattgttgcctatttgatttatcgttttattaaagcattgactggaactaaaatcatgtctttagttcaaggggtcattttctttttggttcttcgttttattgcagagtggattggctttacgacaatcacatacttaatgaaccaagtcattacttatggtgtaattgcaggagtagtcatttttacccctgaaattcgggcaggactggagaaatttggtcgttctacgcaagtttttttacaaaaacagtacgtcagcagtgaatctgctttggtcgatgctttgattaaatctgtggcctatatgggtccacgcaagataggtgcattgattgctattgaacagactcaaaccttacaagaatatattgcgacaggaattccgctgaatgccgacatttcaagtcaactactcatcaatatttttattccgaatacgccgcttcatgatggagctgttatcgttggtcagaataagattgtggcagcctgtgcttacttgcctttgtcagaatcaaaggcaatttccaaagaatttgggacccgtcatagagcggctattggattatctgaaaactctgatgcactaactatcattgtttcagaagaaacaggagctatttcagtaactcgcaaaggccaatttttacacgatttaagcacagatgaatttgaaacggtacttaggacctacctgatgagtaattcaaatgttactttaccatggtataagaaaattctaggagggaaatctaaa

SEQ ID NO: 846 - DNA, 669 bp, Streptococcus pyogenes
atgcctttgtccatccaatgccttaatctttgttttttgttggtaactttttgtccttcaattcctatgcaagctatttttggaaaggaagatagtggttatgcatttaatttaattggttttctaagagcaactctgatttatgacattttggctttggtaagtatttatgttttgtcacctcaaataaccttgtctcttgaaagtattgatagtaagacgttctttatgggacttgtattttgcgtcttgatagtactgattgaactcgttttcttacatggtttacgttgttggcaaaaaaagcaatggcttcctgcaactttctcgtttgtaggaacgacaaatgattggtctaagattggctatcctttattactagctttatttgaagagacgatttatcgttttttgtggtttaatatattagcttttcaatggcatttaccaacaattattgttttaattgtaactagtttttgctatgctttaaatcacttattgatggggaaatccattttttatgctaagttggtaacaggcatcatttatggtagtatttacatgctgactagtcaattgtggttggttgtgataatgcatgtaggaggtaacttgctagttgagtgtcttagccatcttcaaacaaaaaagaagaaggaggtgaca

SEQ ID NO: 847 - DNA, 681 bp, Streptococcus pyogenes
atgatgctattggttttgctgtcgtttttaggtctaactactctttggttgaccagttatcgaagacgttgtttggctagatggcatcttcaatggttagtggccttatcctatcaagattttttagatgtcttactgagtctgtttcaatttgtcgttattatacttgttttattcttttactcagctactattaatctaggagaggttctgacctttttgacacaaactagctggcattggcagattctttgttatttagtgttatatcttatggccatcatagagatgacgcttttagttttaattcttatctttgatgttttgctccagaaagacagtcgattgctctttaaaaaaataacttggctgccttttagacaagataaaccagtcttaagtatacttttactaggcacagttattctagtagacagtctcttttatttgggcttgcttatattattaggagaacagtcgctaacaagtttagcaacgcttattttaggttatgggatagtcaaggcttgtcgctattcaggttggttaaatgtactattagctttttgtcttttcactatagttggactatgggcagttacggcaactttattatatggttggctagtaggtgcgatgatattaacggtgacttatttgatgattagttgcaaagagtat

SEQ ID NO: 848 - DNA, 1125 bp, Streptococcus pyogenes
atggttttatttcatttaatcaaaaaagaaagtttacagatttttagaaaccgaacagccttattgatgatggtgatttttccaattttgatgatcgttattttaagttttgcctttaaatcaagttttaatactgcgacaacagtccctaaattgaccattcgttaccaattagagggtgaaaaaacggattaccagaaaaattttcttgcttttttaaaagttttaaaccaaaaacttcatttagagactaaacctagtaattctcttgaaaaagatcgacaaagggtcagtgaaggagccttaacggctgttttagaagtgaagaagaatcagaccattaaggttattactaataatattaatcagcaaaatgcagatttgatcaatatgctagtaaaaaattatgttgataatgctaaaacttatgactcgatagcagctctttatcctcaacaattaaatcatatcagaaagcgaagtgtggactatgttaaggtcagttcaatacagacaagtaaaggaatgacatcagctgattattatgctatttccatgtttaccatgattactttttatagtatgatgtctgcgatgaaccttgttttgtcagatcgtcaacaacggattacaaatcgtattcacttaacaggagtttctccaagttttttggtctttgggaaattaataggtgctatgttagcaacaactgttcaattgagtcttttatacatttttacaaggtttgttttacgagttaattggggcactaatgagtggatgcttattggtataacagcctccttagtctatctctctgtagctataggtatcgggctaggtataagcattaaaaatgaggcttttttaacggttgcatccaatactattattcctatattcgcctttttaggaggcagttacgttccattgacaacattacacagctctattattaatcaattgtcgaatatatctcctattaaatgggttaatgatagtttgttctatcttatttttggtggtcaatataatccgattcctgtaactttgatcgttaatattagtatcggaacaatttttataatattggcattgataggtatgagaaagcaggtgacgaca

SEQ ID NO: 849 - DNA, 1116 bp, Streptococcus pyogenes
atgatttgttttataaaaactctatttgttaagataaagcgcaaaaaaacaagttatgtgacattctttttaatgcctattttaacgacacttttggctttatctttgagtttttcaaataataatcaagctaaaattgggatattagataaagataatagtcagatatctaaacaatttattgctcaactaaagcaaaacaaaaagtacgacatttttaccaaaatcaaaaaagagcatattgatcactaccttcaagataaatctctagaagcggtattgactattgacaaagggttctcagataaagtgttgcaaggaaaatctcaaaaactcaatatacgttcgattgctaatagcgaaattacagagtgggtaaaggcacagaccaattatctattggaaaattataatattataggggatgtggctctaggtaacgaagatacttttaatagaattctccaaaaaaaccaacagttaaattatgatgttaagcaagtaactttgacagaccgatcacgtagcaaagcagtatcttccacaacgacaggatttttgcttattctaatgttaggtagtacgagcgtgatttacagtggtattttggcagataaatctagtcagttataccatcgattaatgttatcgaacttatctcgttttcgctatatgttgagttacgtctgtgtaggatttgttgcttttacgattcaaattgtcattatgctgagtttgttaaaagtatttaatattagtttttttgttccgacatcacttcttttgattatttttttcctttttagtttattagcgataggctttggcctgctgattggagctatcacacaaaattcccaacaaagtagccagttagctaatcttattgtaatgccgacttcaatgttggctggctgtttatggccattgtctattacgccttcttatatgcaagcaattggtaagttattaccacaaaattgggttttatcagccatagctatttttcaaagtggagggaccttatctcaggcttggccatacttgttagctctaatgggaacagcactagctttgattagtttttcaagtttattattaaaacctaccaaacta

SEQ ID NO: 850 - DNA, 816 bp, Streptococcus pyogenes
ttgaagagtgattttgactttcgaaaagtcagctttcgtgatacaataagtaagattattctattaaaggagaagcctgtgttttacgcttacttacgcggtttagtagtctttttattatgggttgtcaatggcaatgcccactaccatcatgaagaaaagatgttagatgcttctgagaattatattctggtagcaccccatcgaaccttttgggatccagtttacatggcatttgcagcacgtcctaagcagtttatttttatggctaaaaaagagttgtttgcaaatcgtctctttgcttggtggattaaaatgtgtggtgcttttcctattgatcgtgacaaaccgagtccagatgctattcgttaccctgttaatatgctcaaaaagagcaatcgttctcttcttatgtttccaagtggaagtaggcattcgcaagaggtcaaaggaggggtcgctgtgattgctaaattggctaaggtcaagattatgccagcagcctatcaggggcctatgtcggtcaagggattactagcgggagaacgggttgacatgacttttgggaatcccattgacgtctcagatattaaacgcatgaatgatgaagggattgctgaggtggcaaaccgtattcaggcagagtttgatcggattgatgacgagttggcacctttccaaccaggcaaagcaaggaaccctttaacttatctctaccgtttaccattaggattggttttggtggtggtattattattaaccatgttattttcctatattgctagttttgtttggaatccagataaacatcgccat

SEQ ID NO: 851 - DNA, 969 bp, Streptococcus pyogenes
atgaaaacacgtattacagaattacttaatattgattaccccatttttcaaggaggaatggcttgggttgctgatggtgatttagcaggtgcagtttctaatgctggtggtttaggcattataggtggtggcaatgctcccaaagaagtcgttaaagctaatattgatcgtgtcaaagctattactgatagaccttttggggttaatatcatgcttttatctccttttgctgatgatatcgttgatctggtcattgaagaaggtgttaaagtagtaacaacaggcgcaggaaatccaggaaagtatatggaaagactgcaccaggcgggtataatcgttgttcctgttgtcccaagcgttgcgctagccaaacgtatggaaaagcttggggtagatgctgttattgctgagggtatggaagctggaggacatattggcaagttaacgactatgtctttagtaagacaagttgttgaagcggtttcgattcctgtcattgcggcaggtggtatagctgatggtcatggtgcagcagcagcatttatgttaggagcagaggctgttcaaattggaactcgctttgttgttgctaaagaatccaatgctcaccaaaattttaaagataaaatcttagcagcaaaagatattgatacggtgatttctgcgcaggttgtgggccaccctgtccgttctattaaaaataaattgacctcagcttacgctaaagcagaaaaagcatttttaattggtcaaaaaacagctactgatattgaagaaatgggagcaggatcgcttcgacacgctgttattgaaggcgatgtagtcaatggatctgttatggctggccaaattgcagggcttgtgagaaaagaagaaagctgtgaaacgattttaaaagatatttattatggtgcagctcgtgttattcaaaatgaagctaagcgctggcaatctgtttcaatagaaaag

SEQ ID NO: 852 - DNA, 939 bp, Streptococcus pyogenes
atgactaaaatttacaaaactataacagaattagtaggtcaaacacctattatcaaacttaaccgtttaattccaaacgaagctgctgacgtttatgtaaaattagaagcttttaacccaggatcttctgttaaagatcgtattgctttatcgatgattgaagctgctgaagctgaaggtctgataagtcctggtgacgttattatcgaaccaacaagtggtaatacaggtattggtcttgcatgggtaggtgctgctaaagggtatcgagtcattattgttatgcccgaaactatgagcttggaaagacggcaaatcattcaggcttatggtgcagagcttgtcttaacacctggagcagaaggtatgaaaggggctattgcaaaagctgaaactttagcaatagaactaggtgcttggatgcctatgcaatttaataaccctgccaatccaagcatccatgaaaaaacaacagctcaagaaattttggaagcttttaaggagatttctttagatgcattcgtatctggtgttggtactggaggaacactttctggtgtttcacatgtcttgaaaaaagctaaccctgaaactgttatctatgctgttgaagctgaagaatctgctgtcttatctggtcaagagcctggaccacataaaattcaaggtatatcagctggatttatcccaaacacgttagataccaaagcctatgaccaaattatccgtgttaaatcgaaagatgctttagaaactgctcgactaacaggagctaaggaaggcttcctggttgggatttcttctggagctgctctttacgccgctattgaagtcgctaaacagttaggaaaaggcaaacatgtgttaactattttaccagataatggcgaacgctatttatcgactgaactctatgatgtaccagtaattaagacgaaa

SEQ ID NO: 853 - DNA, 768 bp, Streptococcus pyogenes
atgacagatgtatcaagaattttaaaagaagcgcgtgatcaagggcgtttaacaactttggattacgccaaccttattttcgatgactttatggaactgcatggcgatcgccatttttcagatgatggtgccattgtaggtggcctagcttatttggcgggacaacctgttacggtcattggtattcaaaaaggtaagaatttacaggataatttggcaaggaattttggccagcccaatccagaaggttatcgtaaagctttgcgccttatgaaacaggcagaaaaatttggacgaccagttgttacgtttatcaatactgcaggagcctatccaggtgtcggtgcggaagaacgaggacagggtgaggccattgctaaaaatttgatggaaatgagtgatctcaaggttcccattatcgccatcattattggtgaaggaggctctggtggtgcattagccttagcggttgccgatcaggtctggatgcttgaaaatactatgtatgcggttcttagcccagaaggctttgcttctattttatggaaggatggttcaagggcgaccgaggccgctgaattgatgaaaatcacagcgggtgaactctacaaaatgggaatagtagaccgtattattccagaacatggttatttttcaagtgaaatcgttgacatcatcaaagctaacctcatcgaacaaataaccagtttgcaagctaagccattagaccaattattagatgagcgctaccaacgctttcgtaaatat

SEQ ID NO: 854 - DNA, 1560 bp, Streptococcus pyogenes
atgactgaaatttcaattttgaatgatgttcaaaaaattatcgttcttgattatggtagccagtacaatcagcttattgctagacgtattcgagagtttggtgttttctccgaactaaaaagccataaaatcaccgctcaagaacttcgtgagatcaatcccataggtatcgttttatcaggagggcctaactctgtttacgctgataacgcctttggcattgaccctgaaatctttgaactagggattccgattcttggtatctgttacggtatgcaattaatcacccataaattaggtggtaaagttgttcctgctggacaagctggtaatcgtgaatacggtcagtcaacccttcatcttcgtgaaacgtcaaaattattttcaggcacacctcaagaacaactcgttttgatgagccatggtgatgctgttactgaaattccagaaggtttccaccttgttggagactcaaatgactgtccctatgcagctattgaaaatactgagaaaaacctttacggtattcagttccacccagaagtgagacactctgtttatggaaatgacattcttaaaaactttgctatatcaatttgtggcgcgcgtggtgattggtcaatggataattttattgacatggaaattgctaaaattcgtgaaactgtaggcgatcgtaaagttcttctaggtctttctggtggagttgattcttcagttgttggtgttctacttcaaaaagctatcggtgaccaattaacttgtattttcgttgatcacggtcttcttcgtaaagacgagggcgatcaagttatgggaatgcttgggggcaaatttggcctaaatattatccgtgtggatgcttcaaaacgtttcttagaccttcttgcagacgttgaagatcctgagaaaaaacgtaaaattattggtaatgaatttgtctatgtttttgatgatgaagccagcaaattaaaaggtgttgacttccttgcccaaggaacactttatactgatatcattgagtcaggaacagaaactgctcaaaccatcaaatcacatcacaatgtgggtggtctccccgaagacatgcagtttgaattgattgagcccttaaacactcttttcaaagatgaagttcgagcgcttggaatcgctcttggaatgcctgaagaaattgtttggcgccaaccatttccaggtcctggacttgctatccgtgtcatgggagcaattactgaagaaaaacttgaaaccgttcgcgaatcagacgctatccttcgtgaagaaattgctaaggctggacttgatcgtgacgtgtggcaatactttacagttaacacaggtgtccgttctgtaggcgtcatgggagatggtcgtacttatgattataccatcgccattcgtgctattacgtctattgatggtatgacagctgactttgctcaacttccttgggatgtcttgaaaaaaatctcaacacgtatcgtaaatgaagttgaccacgttaaccgtatcgtctacgacatcacaagtaaaccacccgcaacagttgaatgggaa

SEQ ID NO: 855 - DNA, 1812 bp, Streptococcus pyogenes
atgtgtggaattgttggagttgttggaaatcgcaatgcaacggatattttaatgcaaggccttgaaaagcttgaataccggggttatgattcagcaggaatttttgtggctaatgccaatcaaacaaacttgattaaatcagtggggcggattgctgatttgcgtgccaagattggcattgatgttgctggttcaacagggattggtcacacccgttgggcaacgcatggccaatcaacagaggataatgcccatcctcacacgtcacaaactggacgttttgtacttgttcataatggtgtgattgaaaattaccttcacattaaaacagagttcctagctggacatgattttaaggggcagacagatactgagattgcagtacacttgattggaaaatttgtggaagaagacaagttgtcagtactggaagcttttaaaaaatctttaagcattattgaaggttcctacgcctttgcattaatggatagccaagcaactgatactatttatgtggctaaaaacaagtctccattgttgattggacttggtgaaggttacaacatggtttgttcagatgccatggccatgattcgtgaaaccagtgaatttatggaaattcatgataaggagctagttattttaaccaaagataaggtaactgttacagactacgatggtaaagagctgatacgagattcctacactgctgaattagacttatctgatattggcaaagggacttatcctttctatatgctgaaagaaattgatgagcaaccaaccgtaatgcgtcaattaatttcaacttatgcagatgaaactggtaacgtacaggttgatccggctatcattacctctatccaagaggctgaccgtctttatattttagcggcagggacttcctaccatgctggttttgcaacaaaaaatatgcttgagcaattgacagatacaccagttgagttgggcgtggcttctgagtggggttaccacatgcctctgcttagcaagaaaccaatgtttattctactaagccaatcaggagaaaccgcagatagtcgtcaagttttagtaaaggcaaatgctatgggcattccgagtttgacagtaactaacgttccaggatcaaccttatcacgtgaagcaacatacaccatgttgattcatgctggacctgaaattgctgttgcgtctacaaaagcttacactgcacaaattgctgcccttgcctttttggctaaggcagttggtgaggcaaatggtaagcaagaagctcttgactttaacttggtacatgagttgtcattggttgcccaatctattgaggcgactttgtctgaaaaagatctcgtggcagaaaaggttcaagctttgctagctactactcgtaatgctttttacatcgggcgtggcaatgattattacgttgcgatggaagctgctttgaaattaaaagagatttcttatattcaatgcgaaggctttgcggctggtgaattgaaacatggaaccatttcattaattgaggaggacacgccagtaatcgctttaatatcgtctagtcagttggttgcctctcatacgcgtggtaatattcaagaagttgctgcccgtggggctcatgttttaacagttgtggaagaagggcttgaccgtgagggagatgacattattgtcaataaggttcatcctttcctagccccgattgctatggtcattccaactcaactgattgcttactacgcttcattacaacgtggacttgatgttgataagccacgtaatttggctaaagctgtaacagtagaa

SEQ ID NO: 856 - DNA, 1344 bp, Streptococcus pyogenes
atggcaataacagtagctgacattcgtcgtgaagtcaaagaaaaaaatgtaacgtttcttcgcttgatgttcactgatatcatgggcgttatgaaaaatgtggagattcctgcaactaaagaacagttagacaaagtattgtctaacaaggttatgtttgatggttcatctatcgaaggttttgtacggatcaatgagtcagatatgtacctttaccccgatttagacacttggattgtttttccctggggagatgaaaatggagcagttgcaggtttaatttgtgatatttatacagcagaaggaaagccttttgcaggagatcctagaggaaatttaaaaagagccctgaaacacatgaacgagatcggctacaaatcatttaatcttggaccagaaccagaatttttcctttttaagatggatgataaaggtaatccgacacttgaagttaacgataatggtggttattttgatttagcgccaattgacttagcagacaacacgcgccgtgaaattgtgaatattttaacgaaaatgggttttgaagtggaagctagtcatcatgaagtggctgttggtcaacatgagattgattttaaatatgcagatgttttgaaagcttgtgataatattcaaatttttaagctagttgtaaaaacgattgcccgtgaacatggactttatgctactttcatggctaaaccaaaatttggaatagctggatcagggatgcactgtaacatgtctttgtttgataaccaaggtaataatgctttttatgatgaagctgataagcgagggatgcagttatcagaagatgcttattatttcttgggaggactaatgaagcatgcttataactacactgctatcactaaccctacagtgaattcttataaacgattagttccaggttatgaggcacctgtttatgtcgcttgggctggaagtaatcgttcaccgcttatccgtgttccagcatcacgtggtatgggaacgcgtttggagttacgttcggttgatccgacagctaatccttatttagccttggctgttctcttggaagctggattagatggtatcattaacaaaattgaagctccagaacccgttgaagctaacatttataccatgacaatggaagaacgaaatgaagcaggcattattgatttgccatcaacgcttcataatgccttaaaagctcttcaaaaagatgatgtggtacaaaaggcactaggttaccatatctacactaatttcttagaagcaaaacgaattgaatggtcttcctatgcaacttttgtttctcaatgggaaattgaccattatattcataattat

SEQ ID NO: 857 - DNA, 1575 bp, Streptococcus pyogenes
atgattatcaaaaagaaagcaaaagtaaaatatttgctccataaagggaaacatggatttttaagaggaatttttagtagaacaacaatcattgtattattaattattttgcaattagttttcttatttcaatcttatgcctggatggagcagtaccgtgtttggataacgattcttgaaagtgtctttgctattactattgttttatatttagttaatagtgatatggatgctatttcaagaatgacgtggttaattttgattatgattgctccattactagggtcactgtttttaatttatacaaaattggattggggttacagagggctaaaacaaagaataaatcatcttgtagatctgtctgcaccttaccttagcgatgatgacgctatattagaggtattaaaggatagcacatcaaccacatatcatttagtacagtacttagaaagaagtcgtggcaactttccgatttataataatacaagggtaacttacttcccaacaggtgaaactttttttgatagtttaaaagaacagttattcttagctaaaaagtacatttttcttgaattttttattattgcagaaggccaaatgtggggagaaatccttagtattctagaaaaaaaagtcagtgaaggtgtagaagttagggtgttgtttgatggcatgaacgaactatcaacgctatcatcagattacgccaagagattagaacaaatagggattaaagctaaatcatttttaccgatttcaccctttatctctacctattacaattatcgagatcaccgaaaaattgtcgttattgatggggaggtatcattcactggaggtattaatctagcagatgagtacattaatgaagtagagcgttttggccactggaaagatgctggtttaatgcttgagggtgaagcaacagacagctttttaattttgtttttacaaatgtggtctatcacagaaaaagaactgattattgatccttatctttcagatcattctttaaaacttccttcagatggctatgttattccctacggtgattccccgcttgatactgataaaataggtaaaaatgtttatatagacattttaaatcatgctaaagagtacgtttatatcatgacaccttaccttattttagatagcgagatggaacacgctttacggtttgcatcagaacgtggagtagatatccgaattattatgccaggagtgccagataagggggtaccatatgccttagctaaaacctattataaagctttgatgtcttctggagtaaaaatttatgagtatcaaccagggttcgttcattcaaaggtatttatctctgataatacaaaagcagttgtcggaacaattaacttagactatcgtagcctttatcatcattttgaatgcgcgacttatttatatcgtgtgtcagttattgctgatattgtgaatgactttaatgaagctcaaaagcaatcactattgatgacatcagatcatttgacgcaacgtccttggtatcaaaaattgataggattattagtacgaataattgcccctctcttg

SEQ ID NO: 858 - DNA, 813 bp, Streptococcus pyogenes
atgccagataaaaaacaatttcctatttcttacatttcacattgcctttctcctagggcaatgtttgccagccgagctcagtttacttggtggcaaaatcttcttattattgtttttttgaacgccttaataatgattccagttacgttacactatgctaacatgacaacgtatcccttggaacggattgtaactaagagtttgtcgcctatcacagacaaaacctatcaagcattgacccaaggaaagattgagaaagatacgtttcagggtcaatctctgattcgacgagatggtgaattggttttggctgttttaccgacaaaggtcgatttagagcaattggcatcagaatcaaccagacaaattattgtgacaaaaaaagaatggcgttttgttacccctgatggcaaggaactccgtgctcacgttagaggccagcagcagtcactcgctgacctgacaacagttaaagcagtgaaggactttgtcaatcagcaatggtatgacagtaataaagccagtgtacttggttttcttttgctgacgtttgttctcatggtgtgtgtgggtacccttattgtgattggtctaggcgctttctttttgactctgactaaacgatcacgactatttatgattcgaaacttctctgaaggacttggattgatggttaattgtttggcttggccgagtctactggcgattgctcttagtttctttattcaggatccagtactgattatgaattgccaagtatttggtaccttattaatgctgacctgggtgttctacaaaacacagtttagagat

SEQ ID NO: 859 - DNA, 807 bp, Streptococcus pyogenes
gtgaaacaaatcactcaacagaaatggttacgatacggtctttttattgctttagttttaaatggtattgaacttgaattgttaggactgactgctaacaacctttcctttaaagaagcttttgctctaatactaaccattagtctattaggcatttacttaattccatttgcagcagctattttttatttaagtaaaaaatttcatatgaacctgaacgttattattgttagctgtcttagcggactttatatttcaggttttttagcttcttgtgggaaccatctcgtaggacaattttggtcatacatcatcccttctaaagacgctttaaagctttggggagatgctttaactgcccctattgtcgaagagcccattaaggcttcttcggctattttagtaattactttatttcctagacttactcttaaagaaaaattagttgttgctttactttctggcatgggctttcaactaacagaagatatccgttatttgattcaagcaaaatctatagatagtctcgtaccgactgctattgaacgtattagcactgctgtgacttcacattgggtacatacagctatttttaccattggagcatacttattattaaagggttctaaccttttttcaaaacagcaacaaattttctggttattaagtcctctggttctacatttcatctggaactctcctctaacaagcattcctggcatgacagttttactaggaacattaatccttttaatctttggtgatctttttcaaaaaatcaacacccttgacgatgatgtgcttttt

SEQ ID NO: 860 - DNA, 801 bp, Streptococcus pyogenes
atgacatcagtgtttttaaccagtggttgggctttttatgattacctcatctcaccgattccacatgggaaactttttagttggcatgctgtttttgatgccattccaaatattatccaacggcttccaattacgcttggtttgacactatcaggagcaacctttggcttggttttggctttgatttttgcccttgtcaaaattaataaagtgaagctactataccctattcaagctatttttgtgagtttcttgcgaggaactcctattttggtacagttgatgttgacctactacggtattcccctctttctaaaatttctcaatcagaagtatggctttgattggaatgttaatgcaattccggcttctatttttgccattacagcctttgcttttaatgaagcagcctacgctagtgaaactattcgggcagccattttatcagtagatacaggtgaaattgaagcagcaaaaagtctaggcatgacttctgtgcaggtttaccgtcgtgtcattattcctaatgcaactgttgtggctattccaaccttgattaatgggttaattggcttaactaaaggaacatcgcttgcctttaatgcagggattgtcgaaatgtttgcccaggctcaaattctaggcggatcagattaccgttattttgaacgttatatctctgttgctcttgtctattggtctatcagtattttgatggagcaagtaggtcgcttgattgaaaacaagatggccatcaaagcaccagaacaagctagaaatgaaaagttaggagaattgcgt

SEQ ID NO: 861 - DNA, 909 bp, Streptococcus pyogenes
atgactgaacaaattaaattaactaaatcagaccgtcaacgtgtttggtggcgttcacaattcttacaaggttcttggaactacgaacgtatgcaaaacatgggctgggcttatgcacttatccctgctcttaaaaaattgtatacgtctcctgaagaccgtgcagctgctcttgagcgccacatggaattctttaacactcacccatacgttgcagctccaatcattggtgtaacacttgcccttgaagaagaacgcgcaaatggtacgccaattgatgacaaggctatccaaggggttaaaatcggtatgatgggacctcttgctggtatcggtgacccagtattctggtttacgattcgtcctatccttggggcacttggtgcttctttggcttcaacaggtaacatcgttggtccacttctgttcttctttggatggaaccttatccgtatggccttcttatggtatactcaagaatttggttacaaagctggttctgaaattactaaagacatgtcaggcggtatcctccaagacattactaaaggtgcttcaatccttggaatgtttatccttgcagtgcttgttcaacgttgggtatctatcaactttactatcgaccttcctggaaaacaattgtcagatggtgcctatgtggtcttcccagatggcgctgttaaaggtgctgaattgaaaactatccttgccaacgctattggtggtatgagccttgataaagtccaagctcaaacccttcaaggacaattggactctcttatcccaggtttagctggattactccttacattcctttgcatgtggttattgaagaaaaaagtttctccaatcgcaatcatcatcggcttgtttgcatttggtatccttgctcaccttgcaggtattatg

SEQ ID NO: 862 - DNA, 870 bp, Streptococcus pyogenes
atgaaaaaacgagggattgatttactacttgtcacaattggctcattcataacagctattggtttcaatacaatgtttgtcgacaatcatattgcatcagggggtatggttggtattgcagttgttataaaagctctatttggcattagtccgtcgctttttttaatggctagtaatattcccttattattaatgtgttacttctttcttggaaaacaaaattttattaaaacactttatggttcttggatatatcctattgccatccgttcaaccaattcattacctactctgacacacaatcagttgttagcagctatttttggtggtattatctgtggcattggtttaggaatggttttttggggaaactcttcgacaggaggaactggaattctaacacaaatacttcataaatactctcctttatctcttggagttgcaatgacaattgtagatggtattagtgtccttatgggatttattgcactttctgcagatgacgtgatgtattctacgattggacttttcgtaattggttatgtgattagcgttatggaaaatggctttgactcatccaaaaatgttatgattatttccaaagattatcaagctattcgagaatatatcacaactgttatggatcgtggagtgactaaacttcctattcgcggtggttatactacttctgataaaattatgttaatggctattgtatcaagtcacgaattacctactctccaagaaaaaatcctcgaaattgacgatacagcctttattgttgtcatgccagcagctcaagttatgggaagaggatttagtttgactaaacaatacaaacgtgaagacaaagacgttttattgcctatg

SEQ ID NO: 863 - DNA, 1329 bp, Streptococcus pyogenes
atggaaacaataagcaagaaaatgcctcaaaaagacttgtctgagcattcaaaagcatggcaaaataggcgaataggctccgttcccttgcctgtttatctggttttagctaccttaattttagtcacaggctggctccaacaattgcctgttaatatgctgggtggctttgctgttattttaacccttggttggctactaggaaccattggagcgaccattccaggcctcaaacattttggtggcccagctattttatcactcttagtcccttcgattttggttttttttaatctcctcaatcccaatgtcttagaagcgacgaatgtcttgatgaagcaagccaattttctttatttttatattgcctgcctggtctgcggtagtattttaggcatgaatcgaaaaatcttgattcaaggtctttttcggatgattattcccatgttacttggaatggtttgtgcaatgggtgtagggactttggttggcgtcattttaggattagactggcaacataccctcttttatgttgtgacgccagtccttgctggaggaattggtgaaggtattttacccttatctcttggttacagtgccattacaggagtcggaagtgagcaattagtggctcaactgattccagccaccattattgggaatttctttgctatcttgtgcacggctttgctcaatcgttttggagagaagcacccaagttattctggtcaagggcaactggttaaaattggtcacagcgaagacatgtctgatgccctaaaagacaattctggagccctagatgttaaattaatgggggcaggcgttttaacagcttgttcactttttattgctggtggcttgttacagcatttaacagattttccaggaccggtgttgatgattattctggcagccttcttgaaatacctgaatgttattccccaagaaacccaaaatggtgccaagcaactttataaattcatttccagcaactttacttttccgttaatggcagggcttggtctactttatatccccttaaaagaggttgtggcaacccttagctggcaatattttattgtggtgattagtgtggtgttaacggttgtcagtgtcggtttttttgtctctcgtttccttaacatgagcccagtggaagcagctattatttcagcttgtcaaagtggtatgggtggaaccggtgatgtggctattttgagtacggctgaccgcatgaatctaatgccgtttgcccaagtcgctacccgtttaggtggggctattaccgttatcactatgacagctattttaagaattatttttagt

SEQ ID NO: 864 - DNA, 1146 bp, Streptococcus pyogenes
atgataattaaaggagttaccatgaaatttgaaaaaaaacaagtcttctatttagtccttacgtttatcttatgctatgggatcctagcaaactggcgaaatggaacggctatcgtcacgactatttacaaaacaagccttccttttttttatggagcagcaggtgcctatattgttaatattgtaatgagcgcttacgaaaaggtatatgtttatatctttaaagactggtcacatgtcttaaaagtaaaacggggtatttgtttactgttagcgtatttgacattttttattttaattacttggattatttccattgtcattccagacttaattacaagtattagtactctaacaaaatttgatactataacgatacaagaagttgttaacaatcttgagcacaataaactgttagcacgtactattcagtatattggtggcgatggcaaacttacagagacgattgctaactatagtcaacagttattaaagcaatttcttactgttttgacaaatattttaacatctgtcacggttattgcttctgcaattattaatctttttattagttttgttttttcgttatacgttttagcaagtaaagaagatctttgtcgtcagggaaatactttagtagatacttatactggtaagtacgctaaacgcattcattacttgttagagttgttgcatcagcgttttcacggattttttgttagtcagaccttagaagctatgattttaggttcgctgactgctagtggcatgtttatattaagattaccatttgcagggactattggcgttttagtagcttttacagcattgattccagttataggtgcttcaattggagcagctattggatttattttaattatgactcagtccatgtcacaggccattatttttatcatttttttaattattttgcagcagattgaaggcaattttatttatccgaaagtagttggtggatcgattggattaccggctatgtgggtattaatggcaattacaataggcgcttctttaaagggaatagttggtatgattattgcagttcctttagcagcgacactttatcaagtgattaaagataatattcaaaaaagacaagctattcaaaaaaaacaagtttcc

SEQ ID NO: 865 - DNA, 1560 bp, Streptococcus pyogenes
atgcttttgtggtcaatttatttggaggtgatgagcatgcctagtttgtttgtaactttccaaaaccgttttaatgaatggctggcggctctgggggaacacctgcaaatttcccttttatctcttatgatcgccttgctaataggtgtgcctttagcagcccttctcagtcgcagcaaacgttggtcagacattatgttacaggtaacaggtgtttttcaaaccattccctcactggctttgcttggtcttttcatccctttaatgggaattggaacgttgcctgcagtgacagctttagttatctatgcgatttttccgattttacaaaacaccatcacaggattaaatggtattgacccaagtctcgtggaagcaggaatagcttttgggatgaccaaatgggagcgattgaaaacatttgagattccaattgccatgcctgttattatgtcaggtgtgcggacgtcagcagtcatgattatcggcacagctactttagcttccttgataggagccggtggacttggctctttcatcttattagggattgatcgtaataatgctaacctgattctgataggggctatttcttcagctctgctagctattattttcaatagtttgttacagtaccttgagaaagcttccttgcgacggattatgattagttttggaattaccttacttgcactgctagcatcgtatactcctatggcgcttagtcagttttcaaaaggaaaagatacagtggttattgccggtaaattgggagcagagcccgatattctgattaatctctataaggaattaattgaagaccaatcagatataagtgttgagttgaaatctaattttgggaaaactagcttcttatatgaagcccttaaatctggagatattgatatgtatcctgaatttacaggaaccataacatcaagtcttttacgcgacaaaccacctttgtctaatgaccctaagcaggtctatgaggatgctaaaaaaggcattgctaagcaagataaactgacccttctcaagccatttgcttaccaaaatacgtatgctgttgctatgccagaaaaattggctaaggaatatcagattgaaaccatttctgatttaaaagcgcatgctgatactttaaaggccggttttactttggaatttaaggacagagcagatggctataagggaatgcaatctcaatatggattacagctatctgtggcgacgatggagccagctcttcgttatcaagcaattcaatcaggagatatccaagtaacagatgcttactctacggatgctgaaattacgaaataccatttgaaagttttaaaggatgataaacagttgtttccaccttatcagggagctcctttgatgaaaacttccttattaacaaaacatccagaattaaaaggcattcttaatcaattagcgggaaaaattactgaaaaagagatgcaggacatgaactacgaggtatctgttaaaggagcagatgctaataaggtcgctcgagattatctgttgaaaacaggcttaatccagaaa

SEQ ID NO: 866 - DNA, 1725 bp, Streptococcus pyogenes
atgattaaaacagatcatcacctcctaaagcgagtgcttcaggatttgttaaaaaaacctctacctgtttgtattctcgtgatcgctagttttgtacaagttggtttaagtgtttacttgcctgttcttatcggtaaagccgttgatatgagtttgtcagtcaattcttggcaaactttaaaatggctgttggggcaaatgttagttattattgtggtcaacacattgattcaatgggtgatgcctcttgtctatagtcgtttgctatatcaatatagccagcaattgaaagataagcttttggaaaaaattcatcgtcttccttttgcatatctagatcgtcaaaccattggagatttggttagtcgagtgataaccgacactgagcaactgatcaatggtctacaaatggtttttaaccagtttatacttggactattgacgattctgtgtaccattatagctatggcacagattgactggctcatgttaatcttggttttggtgttaacaccaagctccctctttttagctcgttttattgctcaaaagagttttcattatgcacaagcacagaccaaaagcagaggaaatttagctcagtttactgaagaaatccttcgtcaagaaggtttggttcaactgtttaatgctcaagagcagtctatctgtgattatcatgttttaaataaaacctattgcgaggcttcacaaaaagccattttttacgcctcaacagtcaatccagccactcgctttattaatagtgtcatttatgctttactggcaggtttaggggctgttcgtatcatggctggacttttttcagtaggtcagctaaccacttttttaaatgttgttgtccaatataccaaacctttcaacgatatttcatctgtcttggcagagatacagagttctttagcttgtgcgcaaaggctttatgaccttttagatattgaaataaaagagcaagagcactttctaacatttaaggcatcagcggttaaggggcaaattgactttgaagaagtaagtttttcttatcaaaaagacaggcccttactgaaagatattaatttttctgttcctgcgggttccaaggtagcgattgtagggcctacaggtgcaggtaaatcaactttaatcaatttactcatgcgcttttatgaacttgatgctggtagcatcaagttagataaagttcctattaagtgttatgctaaggaagaacttaggtccattactggcatagtattgcaagaaacctggttgaaagatgcgactgttcatgagttgattgcttacggcagtgaagaggctagccgtgatgaagtagtggcagcagccaaagcagctcatgcacacttctttattatgcaacttcctaagacttatgatacttacttaagtgcttctgatgatgctttgtcccaagggcagctccagttattagctattgccagaatgtttttgaaaaaaccaaaagtcttggttctagatgaagccacctcctctattgatattagaacagaagctgttattcaagaggcactaaaagaactcatgagaggaaggaccagctttatcattgcccatcgtttatcaacgattcaatcagctgatttgattcttgttatggatcaaggtcgattggttgagtggggaacacatgccagcttaatgtcaaaaaacggctgttatgttagattacaaaagatagaa

SEQ ID NO: 867 - DNA, 648 bp, Streptococcus pyogenes
atgaaccaaacctttaaacaaagtttacccttatcttttagtgaggaagtagcaaacagcgtgacacacgctatcggagcatttgctatgctcattctacttcctatttcagccagctatgcttatcaaacttatgaccttaaagccgctattggtatctccatctttgtcatcagtctctttttgatgtttttgtcctctacgatttaccactccatggcttatggttcggttcacaaatacattctacgcattattgatcacagtatgatttatattgctatcgcaggaagttatacacctgttgccttatcccttgtttctggttggctaggctatatcattattgttttgcagtggggcattacgctttttgggattttatacaaaatttttgccaaacgtatcaatgaaaaattcagtttgatgctttatatcgttatgggctggctcgttgtgtttatcttgccagtcatcattcaaaaaactagtcttgcttttggtcttctcatgttatttggtggcttgtcttataccattggagcggtattttatgccaaaaaaagaccctacttccacatgatttggcatctctttattttattggcctctgccctccaatttatcgctatcactttctttatgctt

SEQ ID NO: 868 - DNA, 885 bp, Streptococcus pyogenes
atgaacgctaaaaaagtcgataaagtagcaactggtactctttataccattgctggaattattgtagctattttagcttccttaattctatatatccttgtccgtggcttgccacacatcagctggtcctttttaacaggaaaatcgtcttcgtacgaagctggtgggggaattggtatccagttgtataattccttcttcctattgattgttactttaattatttccattcctttatcaactggagcggggatttacttggctgaatatgccaaaaaaggacctgttaccaactttattagaacctgtattgagattctgtcttccctaccatctgtggttgtggggctctttggttacttgattttcgttgtgcagtttgaatatggcttttctattatttcaggggctcttgctttgacggtctttaatcttcctcaaatgacccgtaatgttgaagatagtttactgcatgttcatcatacccaaagagaagcaggattagctttaggcctgtcacgctgggaaacggttttttatgtggttatcccagaagctctcccgggaatggtaacaggtattgtcttagcttcaggtcgtatttttggtgaagcggcagcgcttatctatactgctggtcaatcagcaccagctctggattggtcaaattggaatccacttagtgttactagtccaatctctattttccgtcaatctgagacccttgctgttcatatttggaaagtcaatagcgaagggacaattccagatgctactcttgtatccgcaggaagtgcagcagtgctattaatttttatccttattttcaacttttcagctcactttattgggaagaaacttcattctaaaatgacagcagcgaaa

SEQ ID NO: 869 - DNA, 954 bp, Streptococcus pyogenes
atgggttcagttgaacgtacattaaaaatgaccttggctaccattgttgccattttaattgcttaccaacttcatctggattatgcaatgtcagcggggatcattgccctgttaagtgttttagacacccgtaagtccagtttggtggtcgctaggaatcgcttgctatcttttttcctggcttttgggattgcgatgatgtgctttagcttgtttggttttacgacagtaggttttatgtgttatttgttaattattattcctttgctctatcactttcagatagaggcaggactggttcctataacagtacttgtgacacatttgattgctaaaaaaagtattgcattacctattttatcgaatgagtttatgctcttttttgtagggactagtgtcgctttactatttaatgcttatatgggtccacaagatcagcaaattcggtactatcaccaaaaagttgaatcggatctgaaaggtatcttataccgttttgaaagctttctactggaaggaaaaggtcaaaatgaagggctcttgatcaaaaaccttgataaaatattagatgaagctctaaaactagtttatcgagaaaggcataatcaactatttcagcagaccaattatcaagttcattattttgagatgcgacgacaacaaaatagactattgggacaaatggctatcaacgtaaacacgttaatgagacaaagtaaggaaagtattcttttgtcacatctttttcacgaaactgcttgtcagctaagcgaacaaaatccggctttaaccttgattgatgacatcgaacaattgcttgaaacctttcgtcatggtgatcttcctcaaactcgggaggaatttgagcgacgtgcggttttatttcagctcttacaagacttagagcgctttatcttattaaaggtagagttttatcaggattatcaaaatgac

SEQ ID NO: 870 - DNA, 2634 bp, Streptococcus pyogenes
atgataaagaaaaccttatggaaggatattttgagagctatcaagaatagtaaagggcgattcatttccttatttttcctaatggccttaggctcctttgctttagttggacttaaagtcaccggtccagatatggaacgaacagccagccgttacctcgaaagacaccaggtgatggacctaacggtactggcttctcatcaattttcccaagccgataaacaagagttagatacgttaaaaggggctcatttagaatatggtcatttacttgatgtcagtctaactagcaaccagaaatctcttaggctctatagcgtgccaaagaaagtgtctaagccagtcttggttaaagggagttggccaaagcgagagacagatttggttttatcctcctcacttgctaaaaactatcagattggagatgaactagcagtcacctcacctatggaaggtttgctgacgacaacccattttcaagtggttggttttgcgaattcttcagaagtttggtccaagtccaatttaggaagttcctcaaccggagatggaagtctctacgcttatgcttttgttaatccaaacgtttttaaaagtgcctttaacctgctgcgcatccgttttagtcatcttcgtctgacaaacgctttttccaaagactatcaaaaaagggtaacccaaaaccaagctcatttggataatctacttaaagataatggccagaagcgttatgatgacctccaaaatcagtatgaccttgccttaaaaaatggcagagcagcacttgcaaaggaaacagtgaaactagctgcgagtgaggagaacttaacttttttagaaggctctgctttacaagaagctaagcatcagattgaacaaggcaaacaagcattagccaaggaggaaaagcagttagagcaggtgcaggctacaaaagataagctagaaaaacccagttacctgacttataatcgctcgaccctaccaggaggagaaggatatcatacttatgcaacttcaacgacctccatttcaaatgttggaaatatttttcctgttgttctttatctcgtagctgctctagtagcctttaccaccatgacacgttatgttgatgaagaaagaacaagctctggtctattaaaagccattggttattctaacaaggatatcagtttaaagtttcttatctatgggcttttagccagttttttagggacaactttaggtattattgggggaacttacctcttatctaccttgatttcagagatcttaacaggagctttgactattggaaagactcacctttatagttattggttttataatggcatagcttacttgctggctatgttatctgctgttttaccagcctacttaattgtcaaaaaggaattattcctcaatgcagctcagttattgctgcccaaacctcctagtaagggggcaaaaatctggttggaacaccttacttttgtctggaaagccctgtcctttactcacaaggtgaccatacgtaatatttttcgctataaacaaagaatgctgatgaccattgtaggcgttgcaggctcagtagcccttttatttgcaggcttagggattcagtcgtcattagccaaagtagttgagcatcaatttggtgatttaacgacttatgatattttggctgtcggttcggccaaagcgacagcgacagagcaaactgacttagctagctatcttaaacaagaacctattacagggtaccaaaaggtatcttatgccagcttaacccttcctgtaaagggattacctgataagcaaagtatttccattttatcaagttcagctacttctcttagtccctattttaatctgctggatagtcaggagcaaaagaaggttcccattccaacctctggtgttttgatttctgagaaattagcctcctattacaaggtaaaaccaggtgatcagttggtattgactgatcggaaaggacagtcttataaagtgacgattaaacaggttattgacatgacagttggccattacctgataatgtctgatacctattttaagaatcattttaaaggattggaggctgctcctgcctatctgattaaggtaaaagacaaagatagcaagcacataaaggagacagccagtgacttgttaaccttaaaagcgattagagcagtttcacaaaacgtcaatcatattaaatctgttcagctagtagtcacctctcttaatcaggtcatgaccctccttgtcttcttgtctattttattagcaatcgttatcctttataacttaacgactattaatattgctgagcgtattcgagaattatccactattaaagttctgggattttacgatcaggaggtcaccttatatatttatcgagaaactatttcgctatccctagtaggcattcttttaggtatctatttaggaaaaggcctgcatacttatatcatgacaatgatttcaactggggatattcaatttggtgtaaaggttgatgcttatgtttatctagtgccaattctagtaatccttagcttgttagcggtattaggtatctgggttaatcgccatttaaaaaaggttgatatgttagaagctttgaaatccatagat

SEQ ID NO: 871 - DNA, 1233 bp, Streptococcus pyogenes
atgacacaggatccgattgcaaatttaaaactagccagaaagggcccaatcgttagtattattgtctacttgtcgcttagtgttgccaaattattagctggttatttgttaaatgcaagttcccttattgctgatggatttaacaatttatcggatattgtgggaaatgtagccctgcttattggtcttcacttagctagccaaccagccgatgccaatcataaatttggtcattggaaaattgaagacttatccagccttgtcacttcttttattatgtttcttgtaggtttccaagtactgattcacacaattaaaagtatctttagtggtcagcaagttgatattgaccctcttggggctattgtcggtatcgtttcagcttttgttatgttaggggtttatgtctttaacaaacgtctttccaaacgtgtaaaatccagtgccttagtcgctgcttctaaggataatctagctgatgctgttacttctatcggaacatcaattgctattatagcagcttctttgcatttaccagttatcgatcatatagctgctatgatcattacgttctttattcttaaaacagcttttgatatctttatggaaagttcgtttagtttatctgatggatttgatagccgtcatttgaaaaaatacgaaaaagccattttagaaatccctaaaattgtcgccgttaagtctcaacgagctaggacctatggtagcaatgtctatcttgatattgtacttgaaatgaatcctgatctttcagtctatgaaagtcactctattacagagaaagtggagcagttattgagtgaccaattttctatttatgacattgacattcacgttgagcctgccatgattcccgaagaagagatttttgataatgtcgccaaaaagctctaccgctacgaaaaattaattttgagtaaggttcctgactatgaccactacattgctaagtctttccaactgattgatgcgaatggccaaacagttaactatgaacaatttttgaaccaagaaatttattatccaagtaacttcaaccattttcagattgaatccattagtcaaaaaacgatgttggtaacttaccaattaaatggcaatcaacgtaccagtatttggaggcgtcatgaatcttggtccttactcttccaccaaattacccctatcgctaagaaacaattacatcacacacactatcgtattgtaaaaatg

SEQ ID NO: 872 - DNA, 1254 bp, Streptococcus pyogenes
atgatgatgttttttagccacattccctacatggaaccttacggtaaccccatttactttgtctatcttattttggctttcttaccagtcatcattgggatttttaaacaaaagcgcttaagcacttatgaaaccttggtgagtttggtatttattctctttatgtttggaggagatcattatcaacaattagttgcttttctcttttatcttttgtggcaaatcatcagtgtttttgcttaccagaaataccgtgagaatgctaatagtgcaggagtgttttacttagctattgcgatggccttattcccccttatctgggtcaaagttgctcccctaacaggtccttcttctcaaacactctttagttttctagggatttcatatttgacctttaaaagtattggaatgattattgagatgcgtgacgggactctccaagaggttcgtttaccggattttattcgcttcatgattttcttccccaccttctcaagtggccccattgatcgcttcagacattttcaggaagattatcataaacttcctgaacgtgatgattattttgcaatgctcaataaggcagtcatgtatctcatgttaggttttctatacaagcatatcatttcctattgtttgggtggcatcttacttcctctccttgaaaataaggctttgatggttggtggctactttaataaggaaactattctggttatgtacgtatatggcttgaatctcttttttgactttgctggttattcgatgtttgcgattggtatttcctacctattgggtattcgaacaccagaaaactttaacatgcctttcttatctgcaagtttgaaagatttttggaatagatggcacatgagtttgtccttctggtttagagattatgtgtttatgcgattggttcatctattgattaagcataaaacctttaaaaaccgaaatgtcacttcaggtgttgcctatctggttaatatgctagtcatgggattttggcatggcttaacctggtattatatcgcttatgggcttttccatggtataggacttattattaatgatgcttggattcgtaagaaaaaagaaatcaaccgtcaccgtaagaaaaaaggcttatcacccctctttcaaagcagggcattccatgtcttatgtatcgtggtaactttccacgttgtcatgttttcacttctgttattctctggttttttaaatgacctttggtttaacagaccactacat

SEQ ID NO: 873 - DNA, 2172 bp, Streptococcus pyogenes
atgacgcacaaaataaaagtattgctgcttgcgataatgtctatttttttgacatgcaatattgcaagtgctgaaactattgctattgtttcagatacagcttatgccccatttgaatttaaagactcagatcaaatttacaaaggaattgacgttgatattattaatgaagtagccaaacgtcaatcttgggatttcagtatgagtttcccgggttttgatgcagctgtaaatgctgttcaatctggtcaagcgagtgctctaatggccggtacaaccattacgaatgctcgtaagaaagtctttcatttctcagagccatattacgataccaaaattgtcattgcgacacgtaaagccaatgccatcaaaaaatacagtgacttaaaaggaaaaacggtcggtgttaaaaatggaacagcggctcaagcctttttgaataactataaaaaaaagtatgattatactgttaaaacatttgacacaggtgatcttatgtataatagtttatctgctggttctattgccgctgttatggatgatgaggcggttatccaatacgcaatcagccaaaaccaagatattgctattaacatgaaaggagagcccattggaagctttgggtttgctgtcaaaaagggaagcggatatgattatctagttaatgatttcaatacagctcttaaagctatgaaagctgatggtacctaccaagctatcatgaccaagtggttaggcacagatgataaagctaccaccagtcaggcaacgggaaatccatctgccaaagctacacctacaaaggacagttataaaattgtctctgattcgtcttttgcaccgtttgaatttcaaaatggtaagggcaaatacgttggtattgacatagaattaatcaaagctattgctaaacaacaaggtttcaaaattgaaatcgctaatccaggtttcgatgctgccttaaatgctgtgcaatctagccaagcagatggggtcattgctggtgcaactattactgacgctcgtaaagctatctttgatttttctgatccttattatacttctaatatcattttagctgttaaagctggaaaaaacatcaagaactatgaagacttagacagaaaaacagtcggtgctaaaaacggcacttcatcttactcttggttaaaagaaaacgctcctaaatatggttataatgtcaaggcatttgatgatggttctagcatgtatgatagcttaaattcaggttctgtagatgctatcatggatgatgaggcggttcttaaatacgctatctctcaaggtcgtcgctttgaaacacctcttgagggcatttctactggtgaagttggttttgctgtcaagaaaggaactaatccagaattaatcgaaatgttcaacaatggcttagctgctctcaaaaaatctggtcagtatgatgacattatagataaataccttgactctaagaaagctgcaactccttctgaaaaaggtgctgatgagtctactatttcaggcctattatcaaataactacaaacaactattggcaggacttggaaccacgctcagtttaacccttatttcatttgctattgctataattatcgggatcatctttgggatgatggccgtgtcaccaactaaatcacttcgacttatttcaacggtctttgtggacgttgttcgagggattcctttgatgattgtggctgccttcattttctggggagtaccaaaccttatcgagagtatgaccggccaccagtcaccgattaatgatttcttagctgctacaattgcactgtcacttaatggcggagcctatattgctgaaattgttcgcggtggtatcgaagctgttccagcagggcaaatggaagctagtcgaagtcttggtttgtcttacggaaccacgatgagaaaagtaattctcccacaagctgtgaaactaatgttacctaactttatcaatcagtttgttatttcattgaaggatacaacaatcgtctcagcaattggtttagtggaactcttccaaacaggtaaaatcattattgctagaaattaccagtcgttccgtatgtatgctattttagcaattatttaccttatcatgattatactcttaacaagacttgcaaaacgtttagaaaagaggcttaac

SEQ ID NO: 874 - DNA, 963 bp, Streptococcus pyogenes
atggcagaaaaaaaatggtttgataaggtactgtccaagtggcagtatgaacccattcaagtctttatgaggcatttacaaagtgcagaaatggatttatctgccattgcggttgcgtattaccttatcttaacggcctttccattaattgttattgcagccaatatttttccttacctcaatattgatattgctgatttgttacgtttaatgaagcaaaatttgcctaaagatatttttagaccggcttctgcaattgtagaaaatattttctctaaaccgtctggaagtgttttgggagtagcgactttgacaggattatggacaatgtctcgaagtttgacatcgctacaaaaagctattaataaagcctatggcgcttctcagcatcgagatttctttatcggacacttggttggtttgttgaccagtttaattattttatttttattagcctttgccttaatcttttcaatattttctaaagctgctattcaagtgctggataagcattaccatttgagtgataatatcacaacgattttcttgctcctcattcaacctattacagttttgattatttttgttggcttgatgctactatattttttattacccaatgttaagattaaaaaaattcgctacattttaccaggaaccctatttacatcttttgtgatgacatttttgagtaatctggttggcaattacgttgtgtataatgttgagcggatggtagatattaaaatgtttggttcagttatgatttttatcatcatgctatggtttattttcttagcaagaatcctgattttaggagctatatttaatgcgacctatcaagaaatgtccttggggaaattagaaggtcgtagtggtgatatgatcgctatccttaaaaaaacacttgggaatgattcagatctatctccttcacagtctatcgaagatagtcacactgat

SEQ ID NO: 875 - DNA, 1311 bp, Streptococcus pyogenes
atgacgattataattatggactctaatagtgctcacgagactgataatctatcagtctcttttcttaacttttgttataatagtcttatgaaacgacactttttactcttgaccttttacctctttttaacaggtttaacagctggccttgttgcttttatcttaacaaaagccattcacctgattcagtccctcagttttggattcagtcaaggttcttttagcactatgattgctagtgttccaccacaaagacgagctctttcactcctctttgctggacttcttgcaggtcttgggtggcacctattggctaaaaaaggaaaggacattcaatctattcagcaaatcattcaagatgacatctcatttagtccctggacacagttttggcatggttggctccaattaacgaccgtatctatgggagctcctgtcggccgagaaggagcttcacgggaagtcgctgttaccttgacgtctctttggagccaaagatgcaacttgtcaaaagccgatcaaaaacttttattagcctgcgcttctggcgctgcccttggtgctgtctacaatgctcccttagccactattttatttatcttagaagctattcttaaccgttggtcccttaaaaatatatacgctgcctgcctaacgagctatgtggctgtggaaacagttgctttattacaaggccgacatgagattcaatacctaatgcctcagcaacattggacgctaggaacccttattgggtccgtcctggctggtcttatcctttccctctttgctcacgcttacaaacatcttttgaaacaccttcctaaggctgatgccaaaagtcagtggtttattccgaaagttctcatcgcttttagccttatcgcaggactcagcattttcttcccagagattttaggaaatggcaaagctggattactcttttttctccatgaagaaccacatctgagctatattagctggctacttgttgccaaagctgtcgctatctctttagtttttgcttctggagcaaaagggggtaaaattgctccttctatgatgcttggaggtgctagtggcttactactagctatccttagtcagtaccttattcccttgtctctatcaaatacgttagccattatggttggtgcaacaatctttttaggtgtgatcaataagatacccttggcggcaccagtttttctggttgaaattacaggccaatcgttactaatgattatccctttagcattagctaacctcattttttattttagctatcagttttatcgtttcatccttaaa

SEQ ID NO: 876 - DNA, 924 bp, Streptococcus pyogenes
atggagaaaaagaaaaaagtcgaaaaggttaatgttagaacctttgatcgaaaaaccaatgctatctttaatattctgattggtctgtttgccatctcttgtatcattccttttatcttcgtgattattatttccttcactgatgaaagttacttgattaatcatgggtatagtttttttccagatgtctggtcaactaaggcttaccagtatatttttcaaggagccatgtcccatagaatcatgaggtcatttgggatatccgtgtttattacagtggtgggaacctttattaacacgaccatgacatcaacctatgcttatgcgatttcaagaccttatttcccatacagacgtttttttactgtttatgcacttatcaccatgctctttgcaccagggatggttgctaattacttggtggtcagcaatctccttcatttgaaggatacggtttgggccttgattttaccaatggctctgggcccatttggcatcttggtcatgagaacgttctttaaaaagacagttccagatagcattattgagtcggctcgtatggatggggctagtgaatggatgatttttatgaaaattgtcttaccattagctgttccagggattgccaccatcagtttattttctgccttaacttattggaatgattggtttaacgccttgctttatgtgcaaagtgagaatctttacccaatgcagtacttactgatgaaaattcagagcaacctacaggccttggcacaaaatgctggcatgagtgcacaaatggcagatagcttagcatcgctgccaaaagaatcagttcgtatggctatcgtggttattgcaaccttgccgattgccttgacttacccattcttccaaaagtactttgtcggtggtttgaccattggtggggtgaaggaa

SEQ ID NO: 877 - DNA, 684 bp, Streptococcus pyogenes
atgcaattttccaggaattctgataaaatacaaagaaataaggggaaactaatgaaaaaatttcaattctttttacttatcgagtgtatactgctagctatgggtatcatgacaatcttggataatgatttatcaagttttatcctaattctagttcttatcttattagcattacgcttttataaccaagatagccgcaataattttttactaactgtcagtttattgtttctttttttaattttcatgcttaatccctacattatcatggctgttcttttggggatagtttacattttcattaaccatttttcacaagtcaaaaagaagaatcgctttgccttgattcgtttcaaggaagaaaagattgaagtgaacaataccaagcatcaatggattggtactgctaattatgaaagtgattattattgttttgatgacattaacatcattcgaatctcaggaaatgacacggttgacttaaccaatgttattgtgacaggaatggataatatcattgtgatacgtaaaatttttggaaatacgactatattggtacctattgatgtcactgttactttagatgttagttccatatacggaagcgttgatttttttagatgtcagcaatatgatttgcgcaacgaatctattaagtttaaagaaacggataaccaatccctt

SEQ ID NO: 878 - DNA, 1668 bp, Streptococcus pyogenes
atggctaaacctaacagatctaccttaagcctggtttggcgtttattaaccctaatgaaaactctgctaccttggattatcttggctgttggctttgctgttatgggttttgtcatcacggtaagtattccaactggaatagcttatttaggactactagctattagacaagaagtgattccaatattagctttatatcttttgattgctctagcctttttaagaggttttgttcgttatggagagcattattttggtcattttgttgcttttcatagtttagcagcttttaggaacttgatctttaagaaactaagagctctttctccagcttgcttggatagtcaagacagtggttatttgcttaaaatgattggagaagatattgaggcattagaagttttttttgcccacacaatcgcacctatttgtacagcaatattgtctgcaggtttaatgttctggtacttttgtcaaagtagttggcagttagccttattagctttggcaacctatgcttgtttagccattgttatacccatttattttgctaatattttacaggttttactaaaaagccaaaatgaaggtcgaaaagattacctgtcttattttttagagagtttacgatcagtcaaagatcttttgcaatttcaggtattagacgagcaatttgaacgattaataaaaaaaagtaatcatgtaaatgctcttgatcgtaacgtagcgcaagcccaatttttgcaaatggcattgacttttttctggcttggcttaatgatcttagcattttcttatatggtttttgatgggatatgccatgacagcttatcatttgataaaggcttattaacttttattgctttcactgcttcgttttctccttttttagaactaggacgtttgccattaggttttaagcgtgctatgaatgcggctcgaaatatttttgaccttctagacgaaaatgtcatagtagatgaaggcacaaaacaaatagatcgtttaaggagtgtttcttttgaggacctcagttttgcttatccaaagcgccaagagctggtttttaaggatttaacagttacctttcaagaaaaggggattattggcattaaaggcgaatcaggatctggtaaatcaactttggtgaaattaattatgaaatggtataattggaagacaggagatatttttcttaatgataggaatagttgcttactaaatgctgctaaattacaagatactattgcttatgtgccacaaacagcgcagcttttccaacagtctatccgtgaaaatcttatctttggccgtcaagatatttcagatgagtccatttggaatttagctgaggcttgtggtatgaaagacagactgttagcttgtaaggaaggtttggatacgattatcaagagtccttctgacttttcagctggagaaggtcaacgtttagagttgatgcgagctttattgaaagatgcgagttgctatatttttgatgaacccacgtcaaatttagattctctaaatgaagctatcttgcttgatttaattaaaacacattgtcaaggattggtcttcttaatttctcacaggccatcaaccctagcttgtgttgatcatctattttgcgtaaaaaatggttccctaaaagaggtgaataaaaaa

SEQ ID NO: 879 - DNA, 1761 bp, Streptococcus pyogenes
atgatggaaacagaagatacaatatcaaggggaaaaaggaaaagactgttaaaacgattacgtgaacgaattgcaccaaaaaggtatttgctttatgtgtcagcctttttatcttggttacaatttgtgatgaggatgatcagtttttacctcattgccaaaacgttttcgacctttattttgggtcatgctattgccttaggacgcttggcaggtttactcctacttttaaatgtggtaggctttgttcttgctatattaggcaagcaactgcaagggatcgcttcacaatttgctagagattcactcaaacaatctttctttgaggcttttattgatttagacgggcaatttgatgctcatgccagtgatgctgatattttaacgttggcttcacaggggattgatagtttggatacttattatggttactatttgtctttgtctatgagaaccaagtggaactgcacaactattatgatactagtctttttaatttatccattggcaggccttgtctttttaggagttctgcctctgattccactttcaatcgttgctatgcaaaagcggtctcagccaaacatgagtcattattggtcctcttatatggatgttggtaatttatttatggatgacttaaaaggtcttaatacactgtattcttatcaagcaacagaacgttacgagcaagaattttcgggtaaggcagaacagtttcgaaaggctaccatgtctttgcttggctttcagttacaagcagttggttatatggatgcagttatgtatctgggaattggtttgtcaggttttttagccgttcaagctttggcaacaggccagttatctttttttaatttcctattttttctcttgattgctacagaattttttacaccgattcgtgagcagggttatggcatgcacttggtcatgatgaataccaaaatggctgaccgtatctttagtttcttggatagtgttccagcaagaaaagataacaagagtaaaacagcaataaactttaaccagattgacatccaaaatatttctttagcttatgagaaaaaaacagtgcttagtggggttaccatgacattaacgaagggccaactaacagctatcgcgggggtgtcaggacaaggaaaaacaagtctagctcaactcctcttgaaacgccagtctgcaacgactgggcatattttatttgacggtttagacagtgacaatttgtcgcaagaaactatcaaccagcaggttctttatgtatcggaccaatctaccttattgaaccgtagcatttacgataatttaaggttagcagcaaatctctctaaaaaagaaatcttagattggatagatcaacatggtttgttaagcttcatcaactggctaccagatggtcttgacacaatagttggtgaaaatggtaacctgttatcaccaggccaaaagcaacaggtgatttgcgcaagagctctattaagtaagaggtctctttatatctttgatgaggcaacatctagtctagatgcagaaaatgaacgtattattgacaatttaataacgagattagctaagacagcaatagttattgtgattactcataagatgtctcgactgaaaggagctaaccaagtactctttttaaacacagggcagcctgcttgtttaggcaaaccttgcgacctttatcgggaccaaccaacttatcgtcacctagttgatactcaagcaagactggaggcaagtatttatggc

SEQ ID NO: 880 - DNA, 1823 bp, Streptococcus pyogenes
taagtatttttatagcttttctaaattttatctcagataaaatcattacagaaaaaattggggatagtggtcaagctctagttatcgctaatgggtcattgatttttttgattgtatttttggtggtattcttaatttacttcaataatttctttgtaaaaaaacgtagtcaagagcttggagtcttagcaatactagggttttcaaaaagagaattaacaaaattactaactttagaaaatcttgttattctagttctgagttacttggtaagtttattgctgggaccgactttatattttttagctgtactggcaattactcatctattgaatttaacaatggaagttcagtggtttattacagttaatgagattatagagtctttaggaatattagtcgtagtttttctgattaatgtcatcacaaatggacttatcattagtaaacagtctttgattgaatttgttaatttctcaagaaaggctgagaaaaaaattaagataagaaaagtcagagctattattgctatcactgcattgctattgtcatatattttatgtttggcgacagtgttttcatccacacgaaatatgctattaagcatagggatggtaccggtttctctattgataattgtcttagttgttttaggaacagtgttcaccatcagatatggattggcttttgtagtttcgttgttaaaagaaaataaaaaaaggttataccgtcctctgtctaatatcatctatcccaaatttaactatcgtattgcaacaaaaaataaattattaacagtcttgggaggtcttttaacagtaaccgtttcagttgccggaatgatggtaatgctctatgcttattctcttaatgggatagagaggttgactccatctgccatagaatataatgttgaatcagaaaacggtcaagtcaatgttacaactattttagagaacgaccaagtgagcttggttgatgtcggcctgttgcgattgaatactatcccagaggtgactatcacagactctgggcaaacaataccttattttgatataattaactacagtgactacaaagagttaatgaaagctcaaggcagaacaaattctattgaaggtagtaagtcactcccattgttaataaattattatccaacagaaattagccttggaaaaacctttaacttaggaaatgcatatgatgttactgtaaaacaagtatcaacgaataatgtttttagtttttctacaagtgtcacgaccctggttgtttctgataaattatatgctaaacttagttctcgttttccagagaaagaaatgacaattaggacttttaatggaacttcgattaggtcaagtgaagcattttacaatcagtttagtatggttcctgatgttatcagtagttatagtaaggaacacacagtaaagactgctaatattgcgacttatatctttataactttcctatccatactctttattatttgtacaggtagtattctgtactttacaagcctcatcgaaatcatggaaaataaagaagaatatggctatctaagtaagctaggttatagtaaaaaaatgattcatcggattcttcgatatgaaacaggtatacttttccttattcctgtattcattgggattgtaaatggtggtatgttgcttatttactataaatatttattcatggatacattggtagcaggcaatatcataatgttatctttattgctttgtctgcttttcttcttgataatatatggcacattttatgtattgacattgcggttagtgacatccataatcaaaaat

SEQ ID NO: 881 - DNA, 1257 bp, Streptococcus pyogenes
atgttaggaataataacctttattattatttttggtattttagtgattgtccatgaatttggacatttctattttgctaaaaaatcaggcattctagtaagagaatttgccattggaatgggccctaaaattttttctcatgttgaccaaggaggaactctttataccttgaggatgttacccttgggcggttatgtgcgaatggctggttggggtgatgacaaaactgagatcaaaacaggtactccagcaagtttaacccttaatgagcaaggttttgttaagcgcatcaacttgtctcaaagtaagttagacccaacgagtctcccaatgcatgttacaggctatgacttagaagatcagctgagtattactggcttagttttagaagaaaccaagacatataaggtcgctcacgatgctactattgttgaagaagacggtactgagataagaattgctccgcttgatgttcaatatcaaaatgctagtattggcggacgtttaatcaccaattttgcaggtcccatgaataattttattttagggattgtggtttttatcctcttggtctttttacaaggtgggatgccagattttagtagcaatcatgtccgtgttcaagaaaatggagcagcagctaaggctggtcttcgagataatgaccaaattgtcgcaattaatggttacaaggtgactagctggaatgatctcactgaggctgtagaccttgcaacacgggatctaggcccgtcacagaccattaaggtcacctacaagtcacatcagcgcttaaaaacggtggctgtgaaaccacaaaagcatgcaaagacatacacgataggagttaaggcgagtctgaaaacaggatttaaggataagctcttaggcggtctagaattagcttggagtagggcgtttactattttgaatgctttgaaaggattgatcactggctttagtctcaataaattaggtggacctgttgccatgtatgacatgtccaatcaggctgctcaaaacggcttagagtcagtcttatctcttatggcaatgctttcgatcaatttagggatctttaacctgattccgattcctgcacttgatgggggaaaaatcttgatgaatatcattgaagccattcgtcgcaagcctatcaagcaagaaacagaggcctatatcaccctagctggggttgctatcatggtcgtattgatgattgctgtgacatggaatgatatcatgcgcgtctttttc

SEQ ID NO: 882 - DNA, 975 bp, Streptococcus pyogenes
gtgaaacgtactaccattattatcatctggaaaatcatcagatgtgtcacgcttatttttggggtatctgttttgaccttcgttttgttaaaacaatctccagtagatccagtcatggcaagtgtcaattatgacacatcactaacccctgctcagtacaaagcgattgctcaccactatggcttggataagccagctctagtccaatattttatttggttgaaaaatgtgatacagggagatttagggacctcgctcgtttatcggcaacctgttagtgatattattagatcacgggcaggtgcttctttcatacttatgggactctcttggatcttatcgggtcttattggatttatcttaggaacgttatccgctttccatcaagggaaattacttgaccgagttgtcaggtggttttcataccttcagatatcagtaccaacgttttggattggactcatttttttattaatcttttctgtccagctggggtggttcccgattggtatttcttccccgataggcactttgagtcaagatattacgttagctgatcgagttaagcaccttatgttacctgttttcacgctaagtattctaggcattgccaatgtcacccttcatacgagaactaaaatgatgtcggtgctttctagtgaatatgtcttatttgccagagcgcgtggggaaacacagtggcaaatttttaaacatcattgccttagaaatgctatcgtaccagctattacactgcatttttcctattttggagaattgtttggaggatctgttcttgctgagcaagttttctcatatcctggcttagggtctaccctcactgaagcaggacttaaaagtgatacaccgctccttctagctattgtgatgatagggacattatttgtttttgcgggcaatcttattgcggatattttaaatagcatcatcaatccacagttaaggagaaaagta

SEQ ID NO: 883 - DNA, 1215 bp, Streptococcus pyogenes
atggaagatattattgcagctttaagctctatattatcacacaagatgcggtcaattttgacaatgctagggattattatcggtattggtgccattatcgcaatcttttcaatcatcgaaggtaataccgaaaataccaaaagacagttgattggtggcagcaataacactattaacattgtgtttaacaaaaaaagtagtattgaccctaaatttccagacaagtcaaatgctaaaaaaccagactatcttccttttatggctgaagaagagcttagcaaaatacagcaagtcaaaggcgtcaaaaatgccctgatctcatatggtattgatgacaaagtctaccatctaggccaaaaatcatctgcaaagatttctgccatcacaaaaaacgtagctgaagtgagacgcatgacatttattaaaggcagtgacttttcagacaaagactttattgaccaaaaacaggtgatttaccttgaaaaaagcttgtatgagtcactatttccaaaagacgatggccttggaaaatttgtcgaagtgatgggaaatcccttcagggtcattggggtgtttgaatcaaaagaacaaagtggcctcacaagtgggactgagaaaattgcttatatcccgctacatcagtggtataatattaatggtgtagtggatgcgacacctgagatcacgatccagacctatcgcgcagatgacctcaaacctgtagcaaagcgtgtcagtgatatgctcaatcaaacgatccctaaatcagattatatgtttggtgtcatgaaccttaaagaatttgaacgccaactagacaacctaaacaaatctaattttgtgttattagctggtattgctagtatctctcttattgtaggtggtattggtgtgatgaacattatgctagtatcagttaccgaaagaacgagagaaattgggatcaaaaaagcgcttggcgctagacgtaagcttattttaaaacaatttttaattgaagcggtcattctaaccttgctaggtggtgtgataggggttatttcagggatggtatcaggattgatcatcacaagatcactcgaatatccctatatcctatccttgttctcagttgtcttgagtttagcgttttgttgtattatagggattgtctttggactattaccagccattaaagcgtctaagctagacccaattgaagcattgcgatttgaa

SEQ ID NO: 884 - DNA, 1341 bp, Streptococcus pyogenes
atgatgttaacgaaggggcaacttccctatagtgctgcttttacaacaggagggctcttttactttgttatcattgcattaagttattatttgggatcgacactttggctagtctttgttcaggtgttttgtttttacttatctggtttatatctttataaactcattaattatatgacaggctttcaaaaagtggctttaactttttcaattagctactatttattatctgttagtcttggttttgggggattgtatcctactcaactggctatgccatttatattaatatcggcttggtttttaactaagtattttgcctgtttagtgaaagatgaggcatttattctttttggctttgtaggtgctcttgcaatgctaattgacccgagtacccttatcttttggtcttttgcttgtgtgacagttttttcttataatataagccaaaagcatcttgcaagaggtttttatcaactgctagcttcgatttttggaatgattttagttttttacacagcaggatatttcattttgaacttacaagtgctaaatccttatttatcacaaacgatgatttatccttttactttttttaaatcaggaaacttatcgttgctttttggactggctattcagttgttcttcgctttggggcttggtcttttgacgggaatggagaatgtcattaggcgatttaaaaacaattctgatagggtcgtcaagtggctatttgtcatggtcattctagaatctatacttgtggctatattttcacaagactatcgcccctatcatcttttacctcttttaccttttggattaattttgactgctattcctgttggctatcagtatggtataggattaggtcagagtagtcatcgcagacgtcatggtaaaaatggtgttggtcgagtaatgatgatttatcttaagagacacttttatttgccaattttaattgtagggacaatactaatctgttctacttattgtttcattagtagtattcctcttaatcaggagcgtgatcatattgctagttatttagaacagaaactaaataaaactcaatctatttatgtttgggatgatacttctaaaatttatttggacagtaaagctaaatctgtttctcaatttagttctcctgacatcaatacgcaaaaagagagtcatcgaaaaatattagaagatgaactattagaaaataaggctgcttatatcgttgttaatcgctataaaaacctgcctaaaatcattcaaaaagtattatctactaattacaaagtagataaacagataacgacaaaaagttttattgtttatcagaaaaag

SEQ ID NO: 885 - DNA, 1218 bp, Streptococcus pyogenes
atgcaagagtttttaaaccttcctaagcagattcagctgaggcaactggtacgctttgtgaccattaccttaggcagtagtatctttccctttatggccatgtattatacgacttactttggtacgttttggacaggcctcttaatgatgattaccagtttgatgggatttgttggaactttatacggtgggcatctgtcagatgctcttggtcgcaaaaaagtcattatgattgggtcagtaggaacaacactaggctggtttctgactattttagctaatttgcctaatgcggctattccttggttaacctttgcgggtattttattggtagagattgcttctagtttttatggtcctgcctatgaagctatgttgattgatttgactgatgagagtaatcgtcgatttgtttacaccatcaattattggtttatcaatattgccgtcatgtttggtgcagggctatctgggcttttttatgaccatcattttttagccttgttagtagccttattactcgtcaatgtactttgttttggcgttgcttactactgttttgatgaaactagaccagaaacacacgcttttgaccatggtaaaggattactggcgagttttcagaactaccgtcaggtgtttcatgatcgtgcctttgtcttgtttaccttaggtgccatcttttctggtagtatctggatgcagatggataactatgtgccagtccatttgaaactgtattttcagccaacggctgtattaggtttccaagtaactagttctaaaatgttatcattaatggttttaactaatacattgctgattgtccttttcatgacagtagtaaataaattaacggaaaaatggaaactattacctcagcttgtggttggttctttactatttactctagggatgctcttgtcatttacctttacgcagttctatgctatctggttatcagttgttttgttaacttttggggaaatgataaatgtttctgctagtcaagtcctacgtgctgatatgatggatcattcccaaataggatcttatacaggttttgtgtcaatggcacaacccctaggtgctattttggctagtctactagtatctgtcagccattttacaggtcctttaggcgtgcaatgcttatttgcagtcattgctttgctagggatttattttacggttgtttctgcaaaaatgaaaaaggtg

SEQ ID NO: 886 - DNA, 939 bp, Streptococcus pyogenes
atgattaagaaaacaacctataagaaaaaagttaaatatgtcattagtagaggggccaagaaagttggcctactccacgctctaagaagtatttcaagagaaaaatatgcagagaagatttcggcttctctgctttatggcattctctctagtattgctgtgaattttttcttccagcctgggcatgtttattcaagtggagcaactggtctagcacaggttttttcagctcttagtcatcgtcttttaggctatgattttcccatcgcctttgcgttttatttgattaatattcctttgcttattttagcttggtataaaattgggcatcaatttaccatttttacctttatcacagtcagcatgagttctttctttattcaaatcatgcctcaagtgacgctgacgactgatcctcttatcaatgctatttttggtggtttggttatgggaatgggaattggtacaggtctcaaatcacgtatctctagtggggggactgatattgtcagtttgacccttaggaaacgaacaggcaaggatgtgggcagtctctcattgatggttaatggtgcaattttagcctttgcagggattttatttggctggcagtacgccctttattctatggtctctatctttgtatcaagtcgtgttacggatgccattttcaccaagcaaaagaaaatgcaggcaactattgttaccagccatccagagcgtgtgattcatatgatccataaacgtctgcatcgcggagtgaccagtatcaacgacgcagaagggacttacaagcatgaacaaaaagcagttttgattaccattttgacatgtgaagaatacccagaattcaaatggctgatgttaaaaacagacccacaagcctttgtttcagtggctgagaatgttagaattatcggtcgttttgtggaagatgat

SEQ ID NO: 887 - DNA, 2271 bp, Streptococcus pyogenes
atgttagaagaattgaaaacacttattaaaaatccaaaattaatgattacaatgattggtgtggccctagtgcctgccttatataatttatcctttctaggctcaatgtgggatccttatggtcgggtcaatgaccttcccattgctgttgttaatcatgataagcctgcaaagagagctgataagtcattgacaattgggaatgatatggtggacaagatgtctaaaagtaaagatttagagtatcattttgtctcagctaagcaagctcaagagggacttaaagaaggtgattattatatggttattactttacccgaagatctttctcaacgggcagcaaccttattaaatcccgaaccccaaaaattaactatccgttaccaaacgagtaaaggacatggaatggtcgctgctaagatgggggaaacagcgatggctaagctgaaagagtctgtttcgcaaaacattacgaagacttatacctcagcagtttttagcagtatgacagacctccaatcaggattaaaagaagcctcagctggaagtcaagcacttgcttcaggagcgaagactgctcaggcggggagtcaaacactttcgacgaacttagcagccttaacgggtgctagccaacagtttcaacaaggtactggtcgattgacatcaggtttgactacctatacagatggtgtcaaccaagtcaagaatgggttaggaacattatcaacggacatccccaattatctgaatggggtttctaggttatcccagggagcttctcagcttaatcagggtctttcacagttgacacaagcaacaacactttctgacgagaaagctaagggaattcaatccttaattgtaggactaccagtcctaaatcaaggcattcagcaactaaatacagagctatcaacattgcaaccccctaaccttaatgctgatgagttaggtaatagcttaggagctatcgctcaagctgccaaacaagtcattgctgaagagactgccgctcagaatgaagaattatcggctctccaagctactagcgtttaccaatcattaactgctgaacaacaaggagagttagctgcggccctcagtcaatctgataaaagtcagaccgtatctgcagcccaaactattttaagttctgttcaaactttgtcaacaagtttacagtctctctctcaagaagatcagtcaaaacagttggagcaacttaaggaagctgttgcacagattgctaatcaatccaatcaagctttgccgggagcaagttctgctttaactgaattatcaacgggattagcaaaggtaaatggtagcttaaatcaacaagttctaccaggaagtaatcaattgacaacaggattagcacaattaaacaggtataatactgccattggttctggggtaataaaactctcagaaggtgccaatgccttgtcatccaagtccggagaattactagatggtagccatcaattatcagaaggtgctactaaactagctgatggtagttctcaattgagtcagggtggtcatcaattaacgagcggattgactgaattatcaacaggattgtcaaccttaaatggttccttagccaaagcctctcagcagttatcgcttgtttctgtgactgataaaaatgctaaagctgtcgcaaaacctcttgtgttaaatgagaaagacaaagatggtgttaagacgaatgggatcgggatggcaccttatatgattgctgtttctctaatggttgtggccctttcaaccaacgtcatttttgctaattctttatctggtcgtccggtcaaagataaatgggattgggctaaacaaaaatttgttattaatggttttatttcgactatgggatccattgttctctacttagctattcaattattagggtttgaagcccgttatggtatggaaaccttaggatttattatgctaagtggttggacgtttatggctcttgtcacagctttggtcggttgggatgatcgatatggctcttttgcttctttggtcatgttattgcttcaggttggctcttcaggtggctcttaccccattgagttaagtggagcattcttccaaaagttacatcctttcttaccaatgacttatgtggtatctggtttacgacaaaccatttcattatcaggtcatattggagtagaagtgaaagtcttaactggtttcttactggcatttatggtattagcactactcatttatcgtcccaagaaaacagtc

SEQ ID NO: 888 - DNA, 2574 bp, Streptococcus pyogenes
atgaaaaataataataaatggataattgctggacttgctagttttttgttccctcttagtattatatttatcatccttctatcgatgggcatttattataatagtgataaaacaattctagctagtgatgcttttcatcagtatgttatttttgcgcagaactttcgtaacatcatgcacggttctgatagttttttttatacctttacaagcggactagggataaatttttatgctttaatgtgttattatcttggcagtttcttttctccattacttttcttttttaatttaacctctatgccagatgctatctatttgtttaccttgataaaatttgggttaataggattagctgcatgctattcttttcatagattatatccaaaaatcagtgctttcttgatgatttccatctcagttttttatagcttaatgagcttcttgacaagtcaaatggaactaaattcttggttagatgttttcattcttcttccacttgttatacttggattaaataaacttatcacagaaaataaaaccagaacttattatctttcgatatcattattattcattcaaaattactactttggctacatgattgctcttttttgtattctttacgccttagtttgtcttttacgtctcaatgattttaacaaaatgtttatcgcttttgttaggtttacagctgtgtcaatatgtgctgctttaacaagtgctctagtaatacttcctacctatctagatttgtcaacttatggagagaatctatccccgataaaacagttagttacgaacaatgcttggtttttggatatacctgctaagctctcaataggagtgtacgatactaccaagtttaatgctctgcctatgatttacgtaggattatttcccctaatgcttagtgttatttattttactttagaaagtatccctttaaaaataaaattagccaatgcctgcttgttaacttttattataataagtttttacctacagccacttgatcttttttggcaggggatgcactcaccaaatatgtttttgcatcgctacgcttggtctttttccatagttatcctattactcgcatgtgagactctctctcgactaaaagaagtgactcaaataaaagcaggttttgcttttattttcctcattatactgacatctcttccttatagcttttctcaacaatataattttctacctttaactctttttttacttagtgtttttttattattaggttatactatttcactattttcgtttagaaattctcaaatcccatctacttttatttctgctttcatacttatctttagccttcttgaatcagggttaaacacctactaccagcttcaaggaattaataaggagtggggattcccatcacgacagatatataatagtcaattaaaggatattaacaaccttgtcaactctgtgtcaaaaaatagtcaacctttttttagaatggaaaggctacttccccaaacagggaacgatagcatgaaatttaattattacggcatttcacaattttcctctgtaagaaatagactatctagttctttattggatcgattgggatttcagtctaaaggcacaaatttaaaccttagataccaaaacaatactattattatggacagtctacttggtataaaatataatcttagcgaaggacctccaaataaatttggatttacaaaactaaaaactagcgggaatactactctttatcaaaatcactatagtagccctttagctatattaacacgtaatgtttacaaagatgtcaacctaaatgtcaatacccttgataaccaaaccaaattacttaaccaactaagtgggaaatctttaacctattttaacttacagccagctcaacttatttctggtgctaatcaatttaacggacaaatatctgcacaagcttctgattatcaaaactccgttacccttaattatcaaattaacatccctaaacatagtcaactctatgttagcatacccaatattatattttcaaatcctgatgctaaagagatgcgtattcagacagataatcataatttcatatatactacagataacgcttactctttttttgatttaggatatttcgccgatgccaaagttgctacattttcgtttgtttttccaaaaaataaacaaattagttttaaggaacctcatttttatagtttgtctattgaatcttaccttgaagcaatgaatagcattaaacaaaaaaatgttcatacttacgctaaaagtaatacggtaatcactgattataattcaaaaacgaaaggttctcttatttttacacttccttacgataaaggttggtcagcacaaaaagatgggaaaaatcttccagtcaaaaaagcacaaggaggatttctatcagttactattcctaaaggaaagggacgtgttatccttacctttattcctaatggttttaaattagggttatctctatcttgtgtaggaattatcgcttatatgcttttgtataagtacatagatataaagtctaaattactt

SEQ ID NO: 889 - DNA, 789 bp, Streptococcus pyogenes
ttggttgcttgttctgaaaaacaagatgataaaaacactttaactattggggtgatgacaaaaacagaatctgatcaagcgagatgggataaagttgaagaattattgaaaaaagacaatatcactttgaagtacaaagaatttacagattactcgcaacctaataaggcagttgctaatggtgaagtcgatattaatgccttccaacactataatttcttaaataactggaataaggaaaataaggaacatttggtggccattgctgatacctatatcagcccaattaaccttttctctggaaccagtcaagatggaaaggctaaatacaaatcagtagctgatctgccaaatggtactcaaattgcagtaccaaatgatgcgaccaatgaaagccgtgccctctatgtgctgcaatcagctggcctcattaaattgaatgtgtctggtgatcaattagcaaccattgccaatatctcagagaacaaaaagaaattagatatcaaggaattagatgctagccaaacggcacgtgctttagtatctgctgatgcagctgttgtcaataatagttacgctgttcctgcaaaaattgactacaaaacctctcttttcaaagaaaaagcagatgacaattcaaaacagtggattaacattattgcaggtcaaaaagattgggaaaaatcagagaaggctgatgctattaaaaaactcatcaaggcctaccaaactgatgaggtgaagaaagtcgtggaaaaaacttcaaatggtatagatgtatccgtatgg

SEQ ID NO: 890 - DNA, 2805 bp, Streptococcus pyogenes
atggcctttaacacaagccagagtgtcagtgcacaagtttatagcaatgaagggtatcaccagcatttgactgatgaaaaatcacacctgcaatatagtaaagacaacgcacaacttcaattgagaaatatccttgacggctaccaaaatgacctagggagacactactctagctattattactacaacctaagaactgttatgggactatcaagtgagcaagacattgaaaaacactatgaagagcttaagaacaagttacatgatatgtacaatcattatgctagcggtggcggatccatgagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacctaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgggctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaacgtgcggccgcactcgagcaccaccaccaccaccac

SEQ ID NO: 891 - DNA, 2805 bp, Streptococcus pyogenes
atgagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtacgtcgtcaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaacgtgctagcggtggcggatccatggcctttaacacaagccagagtgtcagtgcacaagtttatagcaatgaagggtatcaccagcatttgactgatgaaaaatcacacctgcaatatagtaaagacaacgcacaacttcaattgagaaatatccttgacggctaccaaaatgacctagggagacactactctagctattattactacaacctaagaaccgttatgggactatcaagtgagcaagacattgaaaaacactatgaagagcttaagaacaagttacatgatatgtacaatcattatgcggccgcactcgagcaccaccaccaccaccac

SEQ ID NO: 892 - DNA, 2508 bp, Streptococcus pyogenes
atgagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtaagaagacaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaacgtgcggccgcactcgagcaccaccaccaccaccaccac

SEQ ID NO: 893 - DNA, 2508 bp, Streptococcus pyogenes
atgagtgtaggcgtatctcaccaagtcaaagcagatgatagagcctcaggagaaacgaaggcgagtaatactcacgacgatagtttaccaaaaccagaaacaattcaagaggcaaaggcaactattgatgcagttgaaaaaactctcagtcaacaaaaagcagaactgacagagcttgctaccgctctgacaaaaactactgctgaaatcaaccacttaaaagagcagcaagataatgaacaaaaagctttaacctctgcacaagaaatttacactaatactcttgcaagtagtgaggagacgctattagcccaaggagccgaacatcaaagagagttaacagctactgaaacagagcttcataatgctcaagcagatcaacattcaaaagagactgcattgtcagaacaaaaagctagcatttcagcagaaactactcgagctcaagatttagtggaacaagtcaaaacgtctgaacaaaatattgctaagctcaatgctatgattagcaatcctgatgctatcactaaagcagctcaaacggctaatgataatacaaaagcattaagctcagaattggagaaggctaaagctgacttagaaaatcaaaaagctaaagttaaaaagcaattgactgaagagttggcagctcagaaagctgctctagcagaaaaagaggcagaacttagtcgtcttaaatcctcagctccgtctactcaagatagcattgtgggtaataataccatgaaagcaccgcaaggctatcctcttgaagaacttaaaaaattagaagctagtggttatattggatcagctagttacaataattattacaaagagcatgcagatcaaattattgccaaagctagtccaggtaatcaattaaatcaataccaagatattccagcagatcgtaatcgctttgttgatcccgataatttgacaccagaagtgcaaaatgagctagcgcagtttgcagctcacatgattaatagtgtacgtcgtcaattaggtctaccaccagttactgttacagcaggatcacaagaatttgcaagattacttagtaccagctataagaaaactcatggtaatacaagaccatcatttgtctacggacagccaggggtatcagggcattatggtgttgggcctcatgataaaactattattgaagactctgccggagcgtcagggctcattcgaaatgatgataacatgtacgagaatatcggtgcttttaacgatgtgcatactgtgaatggtattaaacgtggtatttatgacagtatcaagtatatgctctttacagatcatttacacggaaatacatacggccatgctattaactttttacgtgtagataaacataaccctaatgcgcctgtttaccttggattttcaaccagcaatgtaggatctttgaatgaacactttgtaatgtttccagagtctaacattgctaaccatcaacgctttaataagacccctataaaagccgttggaagtacaaaagattatgcccaaagagtaggcactgtatctgatactattgcagcgatcaaaggaaaagtaagctcattagaaaatcgtttgtcggctattcatcaagaagctgatattatggcagcccaagctaaagtaagtcaacttcaaggtaaattagcaagcacacttaagcagtcagacagcttaaatctccaagtgagacaattaaatgatactaaaggttctttgagaacagaattactagcagctaaagcaaaacaagcacaactcgaagctactcgtgatcaatcattagctaagctagcatcgttgaaagccgcactgcaccagacagaagccttagcagagcaagccgcagccagagtgacagcactggtggctaaaaaagctcatttgcaatatctaagggactttaaattgaatcctaaccgccttcaagtgatacgtgagcgcattgataatactaagcaagatttggctaaaactacctcatctttgttaaatgcacaagaagctttagcagccttacaagctaaacaaagcagtctagaagctactattgctaccacagaacaccagttgactttgcttaaaaccttagctaacgaaaaggaatatcgccacttagacgaagatatagctactgtgcctgatttgcaagtagctccacctcttacgggcgtaaaaccgctatcatatagtaagatagatactactccgcttgttcaagaaatggttaaagaaacgaaacaactattagaagcttcagcaagattagctgctgaaaatacaagtcttgtagcagaagcgcttgttggccaaacctctgaaatggtagcaagtaatgccattgtgtctaaaatcacatcttcgattactcagccctcatctaagacatcttatggctcaggatcttctacaacgagcaatctcatttctgatgttgatgaaagtactcaacgtgcggccgcactcgagcaccaccaccaccaccaccac

SEQ ID NO: 894 - DNA, 306 bp, Streptococcus pyogenes
atggcaaacaaaaaaatccgtatccgtttgaaagcgtacgaacaccgtacacttgatacagcggcagaaaaaatcgttgaaactgcaacacgtacaggtgctacagttgctggaccagttccacttccaactgaacgcagtctttacacaattattcgtgcgactcacaaatacaaagattctcgcgaacaatttgaaatgcgtacacacaaacgtttggtagacatcatcaatccaacacaaaaaactgttgatgctttgatgaaacttgatcttccaagtggtgtcaacgtagaaatcaaactt

SEQ ID NO: 895 - DNA, 276 bp, Streptococcus pyogenes
atgggacgtagtcttaaaaaaggacctttcgtcgatgagcatttgatgaaaaaagttgaagctcaagcaaacgacgaaaagaaaaaagtaatcaaaacttggtcacgtcgttcaacgattttcccaagtttcatcggatatacaatcgcagtttatgacggacgtaaacatgtacctgtttacatccaagaagacatggtaggtcacaaacttggtgaatttgcaccaacgcgtacttacaaaggtcacgcagctgacgacaagaaaacacgtcgt

SEQ ID NO: 896 - DNA, 651 bp, Streptococcus pyogenes
gtgggtcaaaaagtacatccaattggtatgcgtgtcggaatcatccgtgactgggatgcgaaatggtatgctgaaaaagaatacgcggattaccttcatgaagatcttgcaatccgtaaattcattaataaagaattagctgacgcatcagtttcaactattgaaattgaacgtgcagtaaacaaagttattgtttcacttcacactgctaaaccaggtatggttatcggtaaaggtggcgcaaacgttgacgctcttcgtggtcaacttaacaaattaactggaaaacaagtacacatcaacatcatcgaaatcaaacaacctgatttagatgctcaccttgttggtgaaaacattgctcgtcaacttgagcaacgtgttgctttccgtcgtgctcaaaaacaagcaatccaacgtacaatgcgtgcaggagctaaagggattaaaactcaagtttctggtcgtttgaacggtgctgatatcgctcgtgctgaaggttattcagaaggaactgttccacttcacacgcttcgcgctgatatcgactatgcttgggaagaagctgacacaacttatggtaaacttggcgttaaagtttggatttaccgtggagaagttcttccagctcgtaaaaacactaaaggaggcaaa

SEQ ID NO: 897 - DNA, 540 bp, Streptococcus pyogenes
atggcaaatcgtttaaaagaaaaatatactaacgaagtaattcctgcgttgacagagaaattcaattacacatcagttatggctgtgccaaaagttgagaaaattgttctcaatatgggtgttggtgatgctgtatccaacgcaaaaaacctagagaaagctgcagctgaattagcacttatctcaggtcaaaaaccacttattactaaagctaagaaatcaatcgctggcttccgtcttcgtgaaggtgtagcgatcggtgcaaaagttaccctccgtggcgaacgtatgtacgaattcctagacaaattggttagcgtttcacttcctcgtgtacgtgacttccatggcgttccaacaaaatcgtttgatggacgcggaaactacactctcggtgtgaaagaacaacttatcttcccagaaatcagctttgatgatgttgataaagtacgtggtcttgatattgtaatcgtcactactgcaaatactgacgaagaatcacgtgaattgcttaagggccttggaatgccttttgcaaaa

SEQ ID NO: 898 - DNA, 492 bp, Streptococcus pyogenes
atggcatttaaagataatgcagttgaacttgaagaacgcgttgttgcgattaaccgcgttacaaaagttgttaaaggtggacgtcgtcttcgctttgcagctcttgtagttgttggtgatggaaatggtcgtgttggatttggtactggtaaagctcaagaagttccagaagctatccgtaaagcagttgaagctgctaagaaaaacatgatcgaagtaccaatggttggtacaacaatccctcacgaagtttacactaacttcggtggagctaaagtattattgaaaccagctgtagaaggttctggagttgctgctggtggtgcagttcgtgccgtcatcgaattagcaggtgttgctgatattacttcaaaatctcttggttcaaacactccaatcaacattgttcgtgcaactgttgaaggattgaaacaacttaaacgtgcagaagaagttgccgcacttcgtggcatctcagtttctgacttagca

SEQ ID NO: 899 - DNA, 183 bp, Streptococcus pyogenes
ttgagttttgagatatttacactgataatcgggtggaaactggtcgggtatcgggtaatggagtgtggttcttcgtttaagcaaggagattatcgtttggtggttcatatttgcttgttaaatgttagggatgagatgctgagtcagcaaggccatgaagataaagctgactggctagagcct

SEQ ID NO: 900 - DNA, 3564 bp, Streptococcus pyogenes
ttggcaggacatgaagttcgatacggaaaacaccgtacacgtcgtagcttttcaagaatcaaagaagttcttgatttaccaaatttgattgaaattcaaactgactcattccaagatttcctcgattcaggtttgaaagaagtatttgaagatgtacttcctatttcaaactttacggatactatggaacttgaatttgttggttacgaatttaaagaacctaaatatacccttgaagaagctcgtatccacgatgcaagttattctgcaccaatctttgttaccttccgtttggtcaataaagaaactggtgagattaaaactcaagaagtcttctttggtgatttcccaatcatgacggaaatgggtacctttattatcaatggtggtgaacgtatcatcgtttctcagttggtgcgttctccaggtgtttatttcaacgataaagttgataaaaacggtaaagttggttacggatcaacagtgattcctaaccgtggggcttggttggaattagagactgactcaaaagacattgcctacactcgtattgaccgtacccgtaagattccattcacaaccttggttcgtgcccttggtttctcaggtgatgatgaaattgttgatatctttggtgaaagcgaccttgttcgtaataccattgaaaaagacattcacaaaaatccaagtgattctcgtacagacgaagcccttaaagaaatttacgagcgtcttcgtccaggtgagccaaaaactgcagatagctctcgtagtcttttgattgcgcgtttctttgatgcacgtcgttacgatttggctgcggttggtcgttacaaagtgaacaaaaaacttaatatcaagactcgtcttttgaaccaaatcattgctgaaaaccttgtggatgctgaaactggcgaaattttggtagaagctggaactgagatgactcgtagcgtcatcgaatccatcgaagaacaccttgacggtgatttgaacaagtttgtttacacaccaaatgattacgctgtggttactgaaccagttgtccttcaaaagttcaaggttgtgtcaccaattgatcctgatcgtgtagtaactattgttggtaatgccaatccagatgataaggttcgtgcattgacacctgctgatattttggcagaaatgtcttacttcttgaaccttgctgaaggtcttggaaaagttgacgatattgaccacttgggtaaccgtcgtatccgtgccgttggtgaattgcttgccaaccaattccgcatcggtcttgctcgtatggagcgtaacgtgcgtgagcgtatgtctgttcaagacaacgatgtgttaacaccacaacaaatcatcaatatccgtcctgtcacagcagctgtcaaagaattcttcggttcgtctcagttgtcacagttcatggaccaacacaacccattgtcagagttgtctcacaaacgtcgtttatctgccttaggacctggtggtttgacacgtgaccgtgctggttatgaggttcgtgacgtgcattacacgcactatggccgtatgtgtccgattgaaacacctgaaggaccaaacattggtttgattaataacttgtcttcatttggacatcttaataaatatggtttcatccaaacaccttaccgtaaggttgaccgtgcgactggtacggtaactaacgagattgtttggttgactgccgacgaagaagacgaatacacagttgcacaggccaattcgaaactaaacgaagatggcacttttgctgaagaaatcgttatgggtcgtcaccaaggtaataaccaagaattttctgcaagtgttgttgatttcgttgacgtttcccctaaacaggtagttgctgttgcgacggcatgtattcctttcttggaaaacgatgactccaaccgtgccctcatgggtgccaacatgcaacgtcaggctgtgccattgattgatccaaaagcaccatatgttggtactggtatggaatatcaagctgcccatgactcaggcgctgcggtgattgctcagcaaaatggtaaagttgtcttttctgatgctgaaaaagtggaaatccgtcgtcaagatggctcgcttgatgtttaccacattaccaaattccgtcgttcaaactcaggaacagcctataaccaacgcacccttgttaaagtaggagacattgttgaaaaaggtgatttcatcgctgatggaccttctatggaaaatggtgaaatggctcttggacaaaacccagtcgttgcttacatgacttgggaaggttataactttgaggatgccgttatcatgagtgagcgccttgtgaaagaagatgtctacacatctgttcacttggaagaattcgaatctgaaacgcgtgatacaaaacttggccctgaagaaatcactcgggaaatcccaaatgttggtgaagaagccctcaaagaccttgacgaaatgggcattatccgtatcggtgctgaggttaaagaaggcgacatcttagtaggtaaagtcacacctaaaggtgaaaaagacctttctgctgaagaacgtttacttcacgccatctttggggataaatcgcgtgaagtgcgtgatacctcacttcgtgtccctcacggtggtgatggtatcgttcgtgatgtgaaaatctttacacgcgctaacggcgatgaattgcaatcaggtgttaatatgcttgtgcgtgtttacatcgctcaaaaacgtaaaatcaaggtcggagataaaatggccggtcgtcacggaaacaagggtgtcgtttcacgtattgtaccagttgaagacatgccataccttccagacggaacaccagttgacatcatgttgaaccctcttggggtgccatcacggatgaatattggtcaggttatggaacttcaccttggtatggctgctcgtaatcttggtattcacattgcaacacctgtctttgacggggcttcatcagaagacctttgggacactgttcgtgaagctggtatggatagcgatgctaagacggtcctttatgatggtcgcaccggtgaaccatttgacaaccgtgtatccgttggtgtcatgtatatgatcaaacttcaccacatggttgatgataaacttcatgcccgttctgtaggaccatactcacttgttacccaacagccacttggtggtaaagctcaatttggtggacaacgttttggtgagatggaggtttgggcccttgaagcttatggtgcatcaaatgttcttcaagaaatcttgacctacaagtcagatgacgtcacaggacgtttgaaagcctatgaagcgattactaaaggtaaaccaattccaaaaccaggtgtaccagaatccttccgtgttcttgtaaaagaattgcaatcgcttggtcttgatatgcgtgtgcttgacgaggatgataatgaagtggaacttcgtgatcttgatgaaggtgaagacgatgacattatgcatgttgacgatctcgagaaggcacgtgaaaaacaagctcaagaaactcaagaagtttctgaaacaactgacgaaaaa

SEQ ID NO: 901 - DNA, 393 bp, Streptococcus pyogenes
atgattatcaaaagaaacgatatggctcctagtgtaaaagcaggagatgctattttattttatcgcttatctcagacttataaagtagaagaagcagttgtttatgaggactctaaaacatctataacgaaagtcggtcggattattgctcaagcaggtgatgaagtggacctgacagaacaaggtgaattaaaaattaatggccatattcaaaatgaaggactaacttttataaaatcaagagaagctaattatccgtatcgaattgctgataatagttatttgatactcaatgattactatagccaagagagtgagaattacctacaagatgcaattgctaaagatgctataaaaggcacgattaatacacttattcgattaagaaaccat

SEQ ID NO: 902 - DNA, 468 bp, Streptococcus pyogenes
atgagtcgtaaaaatcaagcgcctaaacgcgaagtattaccagatccattatataactcaaaaatcgtaacacgtcttatcaaccgtgttatgcttgacggtaaacgtggtacagctgctactatcgtttacgatgctttcaacgctatcaaagaagcaacaggaaatgacgctcttgaagtatttgaaacagctatggacaacatcatgcctgtacttgaagtacgcgcacgccgtgtcggtggttctaactaccaagtcccagttgaagttcgtccagaacgtcgtacaacacttggacttcgttggttggtaaacgcatcacgtgctcgtggtgaacacactatgaaagatcgtcttgctaaagaaatcatggatgctgcaaacaacacaggtgcatcagttaagaaacgtgaagacactcacaaaatggctgaagctaaccgtgcctttgctcacttccgttgg

SEQ ID NO: 903 - DNA, 687 bp, Streptococcus pyogenes
atggctaaaaaaagcaaacaaatgcgtgctgcacttgaaaaagtagatagcacaaaagcgtacagtgtagaagaagctgtagcattagtaaaagaaacgaacttcgcaaaatttgatgcgtctgttgaagttgcttacaacttgaacattgacgttcgtaaagcagaccaacaaatccgtggcgcaatggtattgccaaacggaactggtaaaacacaacgtgttcttgtttttgcacgtggtgcaaaagctgaagaagcaaaagcagctggtgcagacttcgtaggtgaagacgaccttgttgcaaaaatcaatggtggatggcttgactttgacgttgttatcgcaacgccagacatgatggctatcgtaggtcgtcttggacgtgtccttggacctcgtaacttgatgccaaaccctaaaactggtacagtaacgatggatgttgctaaagccgttgaagagtctaaaggtggtaaaatcacttaccgtgctgacaaagcaggtaatgttcaagctcttattggtaaagtttcatttgatgctgacaaattggttgaaaacttcaaagccttccacgatgtaatggctaaagctaaacctgcaacagctaaaggaacttacatggcaaacgtctcaatcacatcaacacaaggtgttggtatcaaggttgatcctaactcactt

SEQ ID NO: 904 - DNA, 1197 bp, Streptococcus pyogenes
atggcaaaagaaaaatacgatcgtagtaaaccccacgttaacattggtacaatcggacacgttgaccatggtaaaactactttaacagctgcaatcacaactgtattggcacgtcgcttgccttcatcagttaaccaaccaaaagattacgcttctatcgatgctgctccagaagaacgcgaacgcggaatcactatcaacactgcacacgttgagtacgaaactgcaactcgtcactatgcgcacatcgacgctccaggacacgcggactacgttaaaaacatgatcactggtgccgctcaaatggacggagctatccttgtagttgcttcaactgatggaccaatgccacaaactcgtgagcacatccttctttcacgtcaggttggtgttaaacaccttatcgtgttcatgaacaaagttgaccttgttgatgacgaagagttgcttgaattagttgagatggaaattcgtgaccttctttcagaatacgatttcccaggtgatgaccttccagttatccaaggttcagctcttaaagctcttgaaggcgacactaaatttgaagacatcatcatggaattgatggatactgttgattcatacattccagaaccagaacgcgacactgacaaaccattgcttcttccagtcgaagacgtattctcaattacaggtcgtggtacagttgcttcaggacgtatcgaccgtggtactgttcgtgtcaacgacgaaatcgaaatcgttggtatcaaagaagaaactaaaaaagctgttgttactggtgttgaaatgttccgtaaacaacttgacgaaggtcttgcaggagacaacgtaggtatccttcttcgtggtgttcaacgtgacgaaatcgaacgtggtcaagttattgctaaaccaagttcaatcaacccacacactaaattcaaaggtgaagtatatatcctttctaaagacgaaggtggacgtcacactccattcttcaacaactaccgtccacaattctacttccgtacaactgacgtaacaggttcaatcgaacttccagcaggtacagaaatggttatgcctggtgataacgtgacaatcaacgttgagttgatccacccaatcgccgtagaacaaggtactactttctcaatccgtgaaggtggacgtactgttggttcaggtatcgtttcagaaatcgaagcttaa

SEQ ID NO: 905 - DNA, 732 bp, Streptococcus pyogenes
atgacagaaaacattaaagaagctttggaatatgcagtaaatacagctcacgaaaaacctaagactatcttgggtagtgatggtaaagagtattatgatcgcaacaaatattctttggttgaacttaaaactaagtattatccaaaaacattgaatttaaacacgcttgacagtttaattgattatcttaaatcagatatgaacaatattaattccaagcgtcttatggtcattgtagaaggccctcgtgaagttattgtttgcgaagaagatgatgacgaccttaatcgaaatgtgttagtaactgtggaggcaattattccaaatgttcaatttggccactatgattcaccttctgattttaatattagtctgcaatcattattcgttaacgctgacgatcgtaacacagttattgaattcgctagtgcattaaaaatcgaaaatggctcagaaattgttgatgatggcattggtcaaactgccacaattaaacaaggtgtggcaagccttgcaaaagctaaggcgccaaacccagttacattacgtccataccgcacattttctgaagtagaacaaccttcaagtgagttcattttccgcattaatcaacttgctaatatggctttgtttgaagcagatggtggaaagtggcgcttagatgctatcaataatattgctaactacttaaaagaagaacttgctgatcaaactaacattacaattttagct

SEQ ID NO: 906 - DNA, 612 bp, Streptococcus pyogenes
atgcacatggaaaatgtgacaaacgaaaatgtcgaccaagagactactgacttggaaaataatcaacaagaagataaagcatttacacaagatgatctcaaccgagtgggaactaaagagcattctaaaggctataacaaagcagttaaagacttgggttttgatgatgtagagtctgccaaggatgcactaaaagccttccaagagtggcaagagtcacaaagaagcgagtcagaaaaacaaacagaaatcttgaatgctaaagacaaagagcttgaggaagctcgggcaaacaataaggctcttaatgcaaagctagcagcaatgtctttaggtgtgaacgctgaatctattgatgatgtgattgcactatctgagcgtcttgtcactgacgagacaagcatagaggatgcaatcaaaacggttttgggtaagtatcctcactttggccaaacaaaggataaagctcccaaaatcacagtggcaggcaacccgtctgctgataacggacaaggttcggtgtctaaggaagactttgcaaagatgtcttaccaagaaaaactggacctaaaactaaaaaataagaatctttatgaccaattgaaaggaaat

SEQ ID NO: 907 - DNA, 816 bp, Streptococcus pyogenes
atggcagtaggaacaactaaaatggcacaaatgctagaccctgaggttctagcggatatgattgacgcagaggtagggaaagcgattcgctttgctcctcttgctgaagtagatacaactttagaaggacaaccaggtacaactttaacagtgcctaaatgggattacattggtgacgcagaagatgttgccgagggtgaagctatcccaatgactcaacttggcttcaaaaagactactatgaccattaaaaaagccggaaaaggtgtagaaatcactgacgaagctatcttatctgggtatggggatcctgtaggtcaggcagcaaagcaaatcgttgaggctattgaccacaaagtcgatgcagacgtgcttgatgcgttaagtaaatcgactcaaactgtggaagctactgctacggttgatggtgtatctaaagcgctagatatttttaatgacgaagatgacgcagagacagtcattgtcatgaatccggcggatgcctctaccctacgtttagatgccgcgaaggagtggttaggtgctaccgaggttggagcaaatcgtgttgtctctggtgtttatggtgaagttttaggggtacaaattgtgcgttctcgcaaatgccctaaaggaactgcctacatggttcgcaaaggtgcactacgtatcatgcttaaacgtaacacaatggttgaaacagaccgagatatcacaaaagcgattaatcaaatcgtagctaataagcattatggtgtttatctttataaggcagaaaaagccgtcaaaattacacttaaagatgccgcaaaaaag

SEQ ID NO: 908 - DNA, 261 bp, Streptococcus pyogenes
atgagaaaagacattcatccagattatcgtccagttgttttcctagatacaactacaggttaccagttccttagcggctcaacaaaagcttctaaagaaactgttgagtttgaaggtgaaacttacccacttatccgtgtggaaatttcatcagattcacacccattctacacaggacgtcaaaagttcactcaagcagatggacgtgtggaccgcttcaacaaaaaatacggtctcaaagacgcaaacgcagcaaaataa

SEQ ID NO: 909 - DNA, 1746 bp, Streptococcus pyogenes
atgaatcgtattttattatatgttcacttcaacaaatacaataaaataagtgcacatgtttactatcaattggaacaaatgagatcactgttttctaagattgtttttatctcaaatagtaaagtgagtcacgaagatttaaaacgtctcaaaaaccactgtcttattgatgagtttttgcaacgcaaaaataaaggttttgatttttctgcatggcacgatggcttgattattatgggatttgacaagttggaagagtttgactcattgacgattatgaacgatacttgttttggtcctatttgggagatggctccttattttgaaaattttgaagaaaaagagacagttgacttttggggaattactaataatagaggtacaaaagcttttaaagaacatgtccaaagttattttatgacgtttaaaaatcaagtcattcaaaacaaagtttttcaacaattttggcaatcgataatagaatatgaaaacgttcaagaagtgattcagcattatgaaacgcaattaacatccattctcttaaatgaaggctttagttatcagacggtctttgatactagaaaagctgagtcgtcattcatgccacatccggatttttcatattataatccaacagcaattttaaaacaccatgtgccttttataaaagtaaaagctattgatgctaaccagcatatcgctccttacttattgaatctgatacgagaaacaaccaattatcctatagatcttattgtttcacatatgtcgcaaatctctttgccagatactaagtaccttttatctcaaaaatacctaaactgccaacggttagcaaaacaaacttgtcaaaaggtagctgttcatttacatgttttttacgttgatttgctagatgaatttttaacagctttcgaaaactggaacttccattatgatctttttattacaacagatagtgatatcaaaagaaaagagatcaaagaaatacttcaaagaaaaggtaaaactgctgatatacgcgttacgggaaatagaggaagagatatttatccaatgttattactaaaagataaactttctcaatatgattatattggtcatttccatacgaaaaaatcaaaagaagctgatttttgggcaggagaatcttggcgaaaagaattgattgatatgctcgtgaaaccagcagatagtattcttagcgcttttgagacagatgatattggtattataatcgcagatattccaagtttttttagatttaataagattgtcaatgcttggaatgagcatttaatcgctcaagaaatgatgtctttgtggagaaaaatggatgttaaaaaacaaattgattttcaagctatggatacatttgttatgagttatggaacatttgtatggtttaaatacgatgctctaaaatcactttttgatttagaattaactcaaaatgatattccaagtgaacctttaccacaaaactctatattacatgcgattgagcggttacttgtctatatagcgtggggggattcttatgattttaggattgttaaaaatccctatgagttaacaccttttattgacaataaactgttaaatttacgtgaagatgaaggagctcatacctacgttaactttaatcaaatgggcggtatcaaaggagcattgaaatatattatcgttggtcccgctaaagcaatgaagtatatattcttgcgtttaatggagaaacttaaatga

SEQ ID NO: 910 - DNA, 183 bp, Streptococcus pyogenes; identical to SEQ ID NO: 899

SEQ ID NO: 911 - DNA, 1203 bp, Streptococcus pyogenes
atgaatgaatttgaagatttgctaaacagtgttagcgaagtgaaccctggtgatgttgtcactgcggaagttttaactgttgataacggtcaagcaaacgttgttatcgaaggaacaggtgttgaaggtgtcttgacacttcgtgaattgactaacgaccgcgatgctgatattaacgactttgttaaagctggcgacacagttgaagtacttgttcttcgtcaagtagtaggtaaagatactgatacagttactttcctagtatctaaaaaacgtttggaagctcgtaaagcctgggacaaacttgttggtcgtgaaggcgaagttgttactgttaaaggtacccgtgctgttaaaggtggcctttcagttgaatttgaaggacttcgtggatttatccctgcttcaatgattgacactcgttttgttcgcaacactgaaaaatttgttggacaagagtttgatgctaaaatcaaagaagttgatgcagcagaaaaccgtttcatcctatcacgtcgtgaagttatcgaagaggccgctaaagaagctcgtgctgaagtgttctctaagatttcagaaggtgcagtcgttacaggtactgtagcgcgtttaacaagttttggtgctttcattgaccttggtggtgttgacggacttgttcacgtgactgaattgtctcacgaacgtaacgtgtcacctaaatcagttgtttcagttggtgaagaagttgaagttaaagttctttcaattgacgaagaagctggtcgtgtgtcactttcacttaaagcaacaacacctggaccatgggacggcgttgaacaaaaacttgctcaaggtgatgttgttgaaggtaaagtaaaacgcttgactgacttcggtgcttttgttgaagtattaccaggtattgatggacttgttcatatttcacaaatttcacacaaacgtgttgaaaatccaaaagatgtactttctgtaggacaagaagtaacagttaaagttcttgaagtgaatgcagctgatgagcgcgtatcattatcaatcaaagctcttgaagaacgcccagcgcaagctgaaggagacaacaaagaagaaaaacgtcaatcacgcccacgtcgtccaaaacgtgaatcaagacgtgactacgaactcccagaaacacaaactggattctcaatggctgatcttttcggtgatattgaattg

SEQ ID NO: 912 - DNA, 1407 bp, Streptococcus pyogenes
atggcatttgaaattattatgccaaagctgggcgttgacatgcaagaaggcgagatcatcgagtggaaaaaacaagaaggtgataccgtcaatgaaggtgatatccttcttgaaatcatgtcagacaaaaccaatatggaacttgaggcagaagactcaggtgttcttcttaaaattacacgtcaagcaggtgatactgtacctgtaactgaagttatcggttacattggtgcagagggtgaatcagtagatactattgcttcaagtgaaaaaacaacagaaattccagttcctgcttcagcagacgctggaccagcagttgctccaaaagaaaatgtggcaagtccagctcctcaagtggcagcgacagctattccgcaaggaaatggcggaaaagttcgtgctactccagctgcacgtaaggcagcagcagaaatgggcattgaccttggccaagttccaggaacaggaccaaaaggacgtgtccataaagaagacgttgaaaactttaaaggtgctcaaccgaaagcttcaccacttgctcgtaaaattgcagcagacaaaggtattgatttggcaaccgtatcaggtactggctttaacggtaaggtcatgaaagaagacatcatggctattcttgaagcggctaaaccagctgaagcaaaagccccagcagctaaagaagaaaaagttgttgatcttccagaaggtgtggaacacaagccaatgtcagctatgcgtaaggcaatctctaaaggtatgacaaactcttaccttactgcccctacctttacgcttaactacgatattgacatgacagagatgattgcccttcgtaagaagttaattgacccaatcatggctaaaacaggccttaaagtcagctttacagacttgattggtatggcagtggttaaaaccttgatgaaacctgagcatgagtacatgaatgcttccctcatcaatgatgctaatgatattgaattgcaccgctttgtgaaccttggtattgccgtaggtcttgatgatggtcttatcgttcctgttatccatggggctaacaagatgtgcttgtcagatttcgtgcttgcttcaaaagatgtgattaaaaaagcgcaaactggtaagttgaaagcagctgaaatgtctggatcaaccttctctatcacaaacttgggaatgtttggtacgaagacatttaacccaattattaaccaaccaaactcagcaattcttggtgttggagcaactatcccaactccaacggttgtggatggtgagattgtttcccgtccaattatggcaatgtgcctaaccatcgaccaccgtttagttgatggtatgaacggtgcaaaattcatggttgatctcaagaaattgatggaaaatccatttgaattgttaatc

SEQ ID NO: 913 - DNA, 366 bp, Streptococcus pyogenes
atggcattgaacattgaaaacattattgctgaaattaaagaagcttcaatccttgagcttaacgatcttgtaaaagctatcgaagaagaatttggtgtaactgcagctgctcctgtagctgctgcagctgctggtggtgctgaagaagctgctaaagattcattcgacgttgaattgacatctgctggcgacaaaaaagttggcgttatcaaagctgttcgtgaaatcacaggtcttggtcttaaagaagctaaaggtcttgttgatggagcacctgctaacgttaaagaaggcgttgctgctgcagaagctgaagaaatcaaagctaaacttgaagaagctggagcaacaatcactcttaaataa

SEQ ID NO: 914 - DNA, 690 bp, Streptococcus pyogenes
atgttgaaaatacaaaatctaaaaaaatcttatggtaagagaaccatattgaataatgtcaatatgaatattcctaagggaaaagtgtatgctttaatcggtccaaatggtgctggaaaatcaactattatgaaaattttgacaggcttagttagtaagacaagtggttctattatttttgaaggtagagaatggtcacgtcgggatctgcgaaaaatcgggagtattattgaagaaccaccactttataaaaatttgagtgcttacgataatatgaaggtagttacaacaatgcttggtgtttcagaaagcactatacttccattattaaataaagttggtctaggaaatattgacaagagaccagtaaaacaattttctcttggaatgaagcaacggttaggtatagctatctctttaataaattcacctaaactacttatattagacgaacctactaatggcttggacccaattggaattcaagaattaagggaaattatagagtcatttaaatcagaaggaatgacaattatgatttcaagccatatactgtcagaagttgaacatctagctgattttattggatttatctatgaaggaaagattattctggaaaaagaatatgacggctctgagaatcttgaagagttattcaataatcaaattttatttgaaaagaggaggtag

SEQ ID NO: 915 - DNA, 1557 bp, Streptococcus pyogenes
atggcttttgaaagcttaacccaacgtttgcaagatgtgtttaaacacattcgcggtaaaaagaaattatcagaatcagatgttcaagaagtgacaaaagagattcgtctagctcttttagaagccgatgtcgctttaccagttgttaaaacctttattaagcgcgtacgtgagcgcgctattggccatgagattattgatactcttgatccaacacaacaaattcttaagattgttaatgaagaattaacgagtattttaggctcagaaactgcagagattgataaatctccaaaaattccaactattatcatgatggtcggtttgcaaggggctggtaaaacaacttttgcaggaaaactcgctaataaattaattaaagaagaaaacgcgcgaccactgatgattgctgccgatatttaccgtccagcggccattgatcagttaaaaacactggggcaacaaatcaatgtacctgtttttgatatggggacagaccactcagcagtcgatattgtcagaaaaggtttggaacaagctcgtgaaaaccacaatgactatgtcttgattgatactgcgggtcgcttgcaaattgatgaaaaactgatgggagagctgcgcgatgtcaaggctttagcacaaccaaatgaaattcttttggttgtagatagcatgattggtcaagaagctgccaatgtagcctacgagtttaatcatcagttgagcatcacaggggttgtgttaacaaagattgatggtgatacacgtggaggtgcggcgctatctgtccgtgaaatcactgggaaaccaattaaatttacaggtattggtgaaaaaatcacagatattgaaacatttcacccagaccgcatgtccagtcggattttgggaatgggggatttgcttaccctcattgaaaaagctagccaggaatatgatgagaaaaaatccttagagttagctgaaaaaatgcgtgaaaacacctttgatttcaatgattttattgaacagttagatcaagtgcaaaatatggggcctatggaagacctcttgaaaatgattccaggaatggctggtaacccagctttggccaatatcaaagttgacgaaaaccaaattgctcgcaaacgtgctattgtctcttcaatgacacccgctgaacgtgaaaatcctgacttactaaacccgagtcgtcgccgtcgtattgcagctggttccgggaacagctttgtagataataaatttatcaaagactttaaccaagccaaaagcatgatgcaaggggttatgtcgggcgatatgtctaaaatgatgaaagatatgggtattaatcccaataatcttcctaaaaacatgcctgctggtatgccagatatgtcttccttagaaggaatgatgggacaaggtggtatgcctgatttatctggccttggtggtgatatggatatgagtcaactatttggtaaagggtttaaaggaaaaattggccaatttgccatgaaacaggccatgaaacggcaggctaacaaactaaaaaaagcaaagaaaaaacgaaaa

SEQ ID NO: 916 - DNA, 489 bp, Streptococcus pyogenes
atgatggaaaaaactcaaattaaaagcactcttacttatgacgataaggtcatcgaaaaaattgtcggtcatgctttggaaaacgttggcggattactagctgtaacaggtggatttttctcaaatatcaaaaataatttggtgaattctgagtctgtaactgatggtgtttcagttgaagttggtagcaaggaagtagcagttgatttagcaatcattgtagaatacggtaaagatattcctgctattgcagaatctattaaagctattgtttctcaaaacgttgacagtatgacacatttgaaagttgttgaagtcaatgtgaacgttgttgatattcgtactaaggaagaacatgaagctgctagcgttactgttcaagatcgtgtcactagtgcagcttcaagtacttcacaatttgtatcagaacaaacagaaaaattaaaagatactatctctgatactgtaaatagtgatgaggcagctaaa

SEQ ID NO: 917 - DNA, 555 bp, Streptococcus pyogenes
atggtaaagcgagattttataagaaatatattattgttattaattgtgattattggggctattttgttgagaatctttgttttttcaacttttaaagtttctccagaaacagctaatacttatttaaagagtggtgatttagtcacaatcaaaaaaaatattcagcccaaatataaagattttgtggtttatagagttggaaaaaaagattatgtcagtcgagtcattgctgttgaaggcgatagcgtgacttatatggacgatattttttacctcaataatatggtagagtcacaggcttaccttgaaaagatgaaagcacattacttgaatcatgcaccgtttggcacattgtatacagatgattttacagttgctaccatcacagctgataagtatcaaaaagttcctaaggggaagtatcttcttttgaatgataaccggaaaaatacgaatgacagtcgtcgatttgggttaataaatgcctcgcagattaaaggtttagtgacctttagagttttgcctctcagcgattttggatttgtagaagtagag

SEQ ID NO: 918 - DNA, 546 bp, Streptococcus pyogenes
atgattaagttcagtattcgtggagaaaatatcgaagtgacagaagctattcgcgattatgtagaatcaaagcttactaaaatcgaaaaatattttgctaaagaccaagaaatagatgcacgtgttaatttaaaagtttatcgggagagatcttcaaaagttgaggtaacgatcccattagattcagtaacccttcgtgctgaagatgtttcacaggatatgtacggctctattgatttagttgttgataagatcgaacgccaaattagaaaaaataaaaccaaaattgctaaaaaacatcgcgaaaaggttccaactggtcaagtctttacaactgagtttgaagctgaagaagtcgatgagataccagaagtacaagttgtacgtactaaaaatgtgacattaaaaccaatggatgttgaagaagcgcgtttacagatggaactattgggacatgatttctttatctacactgattctgaagatggcgcaacaaacattttataccgtcgcgaagatggaaacctaggattaatagaagctaaa

SEQ ID NO: 919 - DNA, 2859 bp, Streptococcus pyogenes
ttgtcaaagaaaagattacatgaaattgccaaggaaattggtaaaagtagtaaagaggtggttgaacacgctaaatacttaggattagatgtgaaaagccatgcatcaagtgttgaagaagcggatgcgaaaaagattatttcaagtttttcaaaggcttctaaacctgatgtgacagcttctcaaacagtcaaacccaaagaagttgctcaaccctctgtaacagtggtcaaagaaacaggttctgagcatgtagagaaaacacaggtctctaagccaaagagtcgtaattttaaagctgaaagagaggctcgtgcaaaggaacaggctgctcgaaaacaagcaaatggctcttctcatcgttctcaagaacgtcgaggaggttatcgccagcccaataatcatcaaactaacgaacaaggagataagaggattacccatcgttctcaaggtgatacaaacgataagcgtattgagcgaaaagcatcgaatgtatcacctagacatgataatcatcagctagttggtgatcgtaaccgttcctttgctaaggagaatcacaagaatggtcgattcacaaaccaaaaaaagcaaggacgacaagagcctcaatcgaaaagtcctaaaattgatttcaaagctcgtgctgctgccttaaaagctgaacaaaatgctgaatactcacgccaaagtgaaacacgttttcgtgcacagcaagaagctaagcgtttagctgagttggcaagacaagaagctaaagaagcggctctaaaagcacaagctgaggagatgagccatcgtgaagcagcattgaaatctattgaagaagcagaaactaaattaaagtcatcaaatattagtgctaaatctactgctgataatcgccgtaaaaaacaagcacgtcctgaaaagaatcgtgagttaactcatcattcacaagaaggacaaaagaaaaataagaagagttggaatagtcaaaaccaagtgagaaatcaaaaaaatagtaactggaataaaaataaaaagaccaaaaaaggcaaaaatgttaagaataccaacaccgctccaaaaccagtaaccgagcgtaaattccatgaattgccaaaagaatttgaatatactgaaggcatgacagttgccgaaatcgcaaaacgtatcaaacgcgaacccgctgaaattgttaaaaagctgtttatgatgggtgttatggcaactcaaaaccaatctttagatggtgacactatcgaattattgatggtagattatggtattgaggctaaggctaaggtagaagtagatgatgctgatatcgagcgcttctttgaggatgaaaattacctcaatcctgaaaatattgtagaacgcgcacctgttgtaactatcatgggacacgtagaccacggtaagacaactttgcttgatactttgcgtaactcacgtgtggcaacaggagaagctggaggaattactcagcatattggtgcttaccagattgaagaagctggcaagaaaattaccttcttggatactcccggacacgcggcctttacaagtatgcgcgcacgtggagcttccgttaccgatatcaccattttgattgttgcagctgatgatggtgttatgccacaaacgattgaagcgatcaatcactcaaaagctgctggtgttccaattattgttgctatcaacaaaattgataaaccaggtgctaatccagaacgtgttatcgcagaattggcagaatatggtatcatctcaactgcttggggcggagagtgcgaatttgtagagatatctgctaaatttaataaaaatattgatgaactattagaaacagtccttttggttgctgaagtggaagaattgaaagctgatccgacggttcgtgctattggtactgtaattgaagcacgcttagataaaggtaaaggtgctatcgctacgcttcttgtccaacaaggaactcttcatgttcaagatccaatcgttgttggtaatacctttggtcgtgtccgtgccatggtaaatgaccttgggcgtcgtgttaaatctgcggagccatcaacaccagtttccattactggtttgaacgaaacaccaatggctggtgatcactttgctgtttacgctgatgaaaaagctgcgcgtgcagctggtgaggagcgatcaaaacgtgccctcctcaaacaacgtcaaaatacacagcgtgttagccttgataatctctttgatacccttaaagcaggagaaatcaagactgttaatgtcatcatcaaagcagacgttcaaggttctgttgaagcccttgcagcatctcttgtaaagattgaagtggaaggtgtccgtgtcaatgtcgttcactctgctgtaggtgctatcaatgagtctgatgtgacccttgctgaagcatcaaatgctgttattatcggtttcaacgttcgccctaccccacaagctcgtcaacaagcagatacggatgatgtggaaattcgtcttcatagtattatctataaagtcattgaagaagtagaagaagccatgaaagggaaacttgaccctgtttaccaagaaaaaattcttggtgaagccattatccgtgaaaccttcaaagtttctaaagtgggaacaattggtggctttatggtaatcaacggtaaggtgacacgtgattcgagtgttcgtgttatccgtgatagtgtcgttatttttgatggtaaactggccagcttgaaacattacaaagatgacgttaaagaagtcggtaatgctcaagaaggtgggttgatgattgaaaactttaacgatcttaaagttgacgatactattgaagcctatattatggaagaaattgtgagaaaa

SEQ ID NO: 920 - DNA, 936 bp, Streptococcus pyogenes
atgacaaagacagcctttttatttgccggtcaaggtgctcaaaaattagggatggcaagggatttttatgataactttgctattgtaagaaaaacctttgatcaagctagtcaagtattgggatacgatttgcgccgtttgattgatagtgacgagttaaaacttaatcaaactagctatacgcaaccagctattttgacatcatcaattgctatttaccgtgttttgggcttacatcacgttaaaccggatatggtagctggtctttccttaggagaatactcagctttggtagcatcaggggcactctcttttgaagataccctatccttagtagctaagagaggccgcttgatggaggaagcagcaccacaaggatctggaaagatggttgccgttatgaatacagacgtgcaagtcatcgaagaagtctgtcaaatagctgctaaacatggagtggttgctccagcaaactataatactcctagtcaaattgtaattggtggtcagacagatgctgtgaacgtggcagttgaacttttaaaggaaaggggagttaagcgtttaatccctttaaacgtgtcaggtcctttccacactgctttgttagaaccagctagccgcttgttggctaaagagttggaaagatacaacttcagtgacttcaagattcctttggttggtaataccgaagctaatattatggaaaaagaccgtatcccagaactattagcccgtcaagtcatggagcctgttcgtttttatgacagtgttgcgactttagtagaaagtggcataacacaattcattgaggtaggaccaggtaaggttttgacaggttttgtgaagaaaattgataaaaatttactatgtactagtgttgaaaacatggtaagcttacgtttatttttagatagagaggacattcatggaaat

SEQ ID NO: 921 - DNA, 2517 bp, Streptococcus pyogenes
atggccaatattctacgcaaagttatcgaaaatgacaaaggcgaactaagaaaattagaaaaaattgcaaaaaaagtagaatcctacgcagaccaaatggcgtcattgtcggatagagatctacaaggaaaaacacttgaatttaaagaacgctatcaaaaaggtgagaccctcgaacaactattacctgaagctttcgcagttgttcgtgaagcagcaaaacgtgtgttgggcttgttcccttatcgtgttcaaattatgggaggaattgttcttcataacggggatgtccctgaaatgcgtactggtgaaggaaaaactcttacagccaccatgccagtttatctcaatgctattgctggtgagggtgttcacgttattactgttaatgagtatctttcaacgcgtgacgctaccgaaatgggtgaagtgtatagctggttaggtctttcagttgggatcaacctagctgctaagtctcctgctgaaaaacgtgaagcttataattgtgatattacttattcaaccaactctgaagtcggttttgattaccttcgtgacaacatggttgttcgccaggaagacatggtacaacgcccactcaattttgccttggttgatgaagtggactcagtcttaattgacgaggcaaggacacctttaattgtttctggtgctgttagctctgaaaccaatcaattgtatattcgtgctgacatgtttgtaaaaactctgacgtcagtggattatgttattgatgtgcccactaaaacgattggattaagcgattcaggtattgataaagctgagagttactttaacttgagcaatctttacgatattgaaaatgtagccttgactcactttatagacaacgcccttcgtgcaaactatattatgttgttagatatcgattatgtggtcagcgaagatggtgagattcttattgttgaccaatttacaggtcgtacgatggaagggcgtcgcttctcagacggcttgcaccaagctattgaggcaaaagaaggcgttcgtattcaggaagaatcaaaaaccagcgcctcaatcacttaccaaaatatgtttcgtatgtacaaaaaattggcaggtatgactggtactgcgaagaccgaggaagaagaatttcgcgaagtttataacatgcgtattattccaattccaaccaatcgtccaattgcccgtattgatcacactgatttgctttacccgaccttagaatcaaagtttagagcagttgtggaagacgttaaaacgcgtcatgcaaaaggacaacctatccttgtaggtacggttgctgttgaaactagtgatttgatttcacgcaagctggttgaagcagggattcctcatgaggttttgaatgctaaaaatcactttaaagaagctcaaatcattatgaatgctgggcaacgtggtgctgttacaatcgcaactaacatggctggtcgtggtactgatatcaagcttggtgaaggtgttcgtgaacttggtgggttatgtgtcattggtacagagcgtcatgaaagccgtcgtatcgataaccagcttcgtggacgttcaggtcgtcaaggagatccaggtgaatcccaattctatctttcattagaagatgatttgatgagacgtttcggctctgatcgtataaaagcctttttggatcggatgaaattagatgaagaagacactgttattaaatcaggtatgttagggcgtcaagtggaatctgctcaaaaacgggttgaaggaaataactatgatacccgtaaacaggtcttacaatatgatgatgtgatgcgtgaacagcgtgaaattatctatgctaaccgtcgtgatgtcataactgctaatcgagatcttggcccagaaattaaagctatgatcaagcgtactatcgaccgtgctgtagatgctcatgcacgtagcaatcgtaaagatgctatagatgctattgtaacttttgctaggacctcgctggtaccagaagagtttattagtgctaaagagttacgtggtttaaaagatgatcaaatcaaagagaagctttatcaaagagcgcttgctatctacgaccagcaactatcaaaacttcgtgatcaagaagctattattgaattccaaaaagtactcattttgatgattgtggataacaaatggactgaacacattgatgccttagatcaacttcgtaatgctgttggacttcgggggtatgctcaaaataaccctgtggtggaataccaagcagaaggtttcaagatgttccaagatatgattggtgctatcgagtttgatgtaacacgtaccatgatgaaagcacaaattcacgaacaagaacgtgaacgtgcaagtcaacgtgccacaacagcagcacctcaaaacatccaatcgcagcagtcagctaacaccgatgatttacccaaagtggagcgtaacgaagcttgtccatgtggttcaggcaaaaaattcaaaaattgtcacggtcgtaaatccttctca

SEQ ID NO: 922 - DNA, 312 bp, Streptococcus pyogenes
atggcattagaagtaacagatgctacatttgtagaagaaactaaagaaggtttagtactcattgatttttgggcaacttggtgtggtccatgtcgtatgcaagcaccaatcttagaacagttatctcaagaaatcgatgaagatgaactcaaaattttgaaaatggatgttgatgaaaatccggaaactgctcgtcagtttggtattatgtcaattccaacattgatgtttaaaaaagacggagaagtggttaaacaagttgcaggtgttcatactaaagaccaattgaaagctattattgctgaattgagt

SEQ ID NO: 923 - DNA, 198 bp, Streptococcus pyogenes
atgtcagaagaaaaattaaaatcaaaaattgagcaagcatctggtggcctaaaagaaggtgctggtaagttgacaggtgataaagagctagaagcaaaaggatttgttgaaaaaacaattgctaaaggcaaagaacttgcagacgatgcaaaggaagcggttgaaggtgctgtagatgccgttaaggaaaaattaaaa

SEQ ID NO: 924 - DNA, 1629 bp, Streptococcus pyogenes
atggcaaaagatattaaattttcagcagatgcgcgtgctgccatggtgcgcggagttgatatgttagcagataccgtcaaagtaacgcttggtcctaaagggcgcaatgttgttcttgaaaaagcttttggttctcccttaattactaatgacggggtaaccattgctaaagagatcgaattagaagatcattttgaaaacatgggagcaaaattggtgtctgaagtggcttctaaaaccaatgatattgctggtgatgggacgactactgcaacagttttgacacaagccattgttcatgaaggactaaaaaatgtgacagcaggtgctaatccaattggtatccgtcgaggcattgaaacagcaacagcaacagctgttgaagccttgaaagccattgctcaacctgtatctggcaaggaagctattgctcaggtcgctgcagtatcatcacgctctgaaaaagttggagagtatatctcagaagctatggagcgtgtgggcaacgatggtgtgattaccatcgaagaatctcgaggtatggaaacagaacttgaagtggttgaaggcatgcaatttgaccgtggttacctgtctcaatacatggtcacagacaatgaaaaaatggttgcagaccttgaaaacccatttatcttaatcacggataaaaaagtgtcaaacatccaagacattttgccactacttgaggaagttcttaaaaccaaccgtccattactcattattgcagatgatgtggatggtgaagcacttccaacccttgtcttgaacaagattcgtggtactttcaatgtggttgctgtcaaagcgccaggatttggtgatcgtcgtaaagctatgcttgaagacattgctatcttgacaggtggtacagtgattacagaggatctaggacttgaattaaaagatgctacaatgacagcccttggacaggctgctaagattacagttgataaagatagcacagtaattgttgaaggttcaggaagttcagaagctattgctaaccgtattgcactgattaaatcgcaattagaaacaacaacttctgactttgaccgtgaaaaactacaagaacgtttggcgaaattagctggtggtgtagctgttatcaaagtaggagctccaacagagacagctttaaaagaaatgaaacttcgcattgaggatgctctaaatgctacacgtgcagccgttgaagaaggtatcgttgctggtggtggaacagcacttattacggttattgaaaaagtagcagctcttgagcttgagggcgatgatgctactggacgtaacattgtgcttcgtgctctagaagagcctgtacgtcaaattgctttaaatgctgggtacgaaggctccgtagttattgacaagttgaaaaacagccctgcaggaacaggatttaatgctgcaacaggtgagtgggttgatatgattaaaacaggaatcattgaccctgtcaaagtaacacgatcagcgcttcaaaatgcagcttctgtagctagtcttattttgacaacagaagcagttgttgctaataaacctgaaccagctacgccagcgccagcaatgccagcaggtatggatccaggaatgatgggcggcttc

SEQ ID NO: 925 - DNA, 765 bp, Streptococcus pyogenes
atggcagtaatttcaatgaaacaacttcttgaggctggtgttcactttggtcaccaaactcgtcgctggaaccctaagatggctaaatacatcttcacagagcgtaacggtatccacgttatcgatcttcaacaaactgtaaaattagctgaccaagcttacgaatttgttcgtgatgctgcagcaaacgatgctgtcatcttgttcgttggtactaaaaaacaagctgctgaagcagttgctgacgaagcaacgcgtgcaggccaatacttcatcaaccaccgttggttgggtggaacgcttaccaactggggaactatccaaaaacgtatcgctcgtttgaaagaaatcaaacgtatggaagaagaaggaacctttgacgttcttcctaagaaagaagttgcacttcttaacaaacaacgcgctcgtcttgaaaaattcttgggcggtatcgaagatatgcctcgtatcccagacgtaatgtacgttgttgacccacataaagaacaaatcgctgttaaagaagctaaaaaacttggtatcccagtcgtagcgatggttgatacaaacgctgatccagatgatatcgatatcatcattccagctaacgatgacgctatccgcgccgttaaattaatcactgctaaattagctgacgctattatcgaaggccgtcaaggtgaagatgcagacgttgcttttgaagctgacactcaagcagattcaatcgaagaaatcgttgaagttgtcgaaggcgacaacgct

SEQ ID NO: 926 - DNA, 1038 bp, Streptococcus pyogenes
atggcagaaattacagctaagcttgtaaaagaattacgtgaaaaatctggtgctggcgttatggacgctaaaaaagcacttgttgaaacagatggtgacatggacaaagccgttgaacttcttcgtgaaaaaggaatggctaaagcagctaaaaaagctgaccgtgttgccgctgaaggtttaacaggcgtttacgttcatggtaacgttgctgctgttgttgaagttaacgctgaaacagactttgttgctaaaaatgctcaattcgttgaattggtaaacgcaactgctaaagttatcgctgaaggcaaaccagctaacaacgatgaagcacttgcacttgttatgccttcaggtgaaactcttgctgaagcttacgttaatgcaactgctaccatcggagaaaaaatctcattccgtcgttttgctttgattgaaaaagcagatgagcaacacttcggtgcttaccaacataatggtggccgtatcggggttatctcagttgtcgaaggcggcgacgatgctcttgctaaacaagtatcaatgcatatcgctgcaatgaaaccaactgttctttcatacactgagcttgatgcacaattcatcaaagatgaacttgctcaattgaaccacgctatcgaacttgacaacgaatctcgtgcaatggttgataaaccagctcttccattcttgaaatacggttcaaaagctcaattatcagacgatgtgattactgctgctgaagcagacatcaaagctgaacttgctgctgaaggcaaaccagaaaagatctgggacaaaatcatcccaggtaaaatggaccgcttcatgcttgacaacactaaagttgaccaagcttacactcttcttgcacaagtttacatcatggacgacagcaaaactgttgaagcttaccttgactcagtaaacgctaaagcgattgcttttgcacgttttgaagttggtgaaggtatcgagaaaaaagctaacgactttgaatcagaagttgcagctactatggctgctgcccttaacaac

SEQ ID NO: 927 - DNA, 609 bp, Streptococcus pyogenes
atgtcacgttatactggtccatcatggaaacaatcacgtcgccttggtttatcacttacaggcacaggtaaagaattggcacgtcgtaactacgttcctggtcaacacggtccaaacaaccgtagcaaactctcagaatatggtttgcagttagctgagaaacaaaaacttcgtttctcatacggtttaggtgaaaaacaattccgtaacttgttcgttcaagctacaaaaatcaaagaaggaactcttggtttcaactttatggttcttttagaacgtcgtcttgacaacgttgtttaccgtctaggtttagcaactactcgtcgtcaagcacgtcaattcgttaaccacggtcacatccttgttgacggtaaacgcgttgatatcccttcataccgcgttgatccaggtcaagtgatttcagttcgcgaaaaatcaatgaaagtacctgcaatccttgaagctgttgaagctactcttggacgtccagctttcgtatcatttgatgctgaaaaacttgaaggttcattgactcgccttccagaacgcgatgaaattaacccagaaatcaatgaagcacttgtcgttgaattctataacaaaatgctt

SEQ ID NO: 928 - DNA, 1971 bp, Streptococcus pyogenes
atgaagaaaagtaaatggttggcagctgtaagtgttgcgatcttgtcagtatccgctttggcagcttgtggtaataaaaatgcttcaggtggctcagaagctacaaaaacctacaagtacgtttttgttaacgatccaaaatcattggattatattttgactaatggcggtggaacgactgatgtgataacacaaatggttgatggtcttttggaaaacgatgagtatggtaatttagtaccatcacttgctaaagattggaaggtttcaaaagacggtctgacttatacttatactcttcgcgatggtgtctcttggtatacggctgatggtgaagaatatgccccagtaacagcagaagattttgtgactggtttgaagcacgcggttgacgataaatcagatgctctttacgttgttgaagattcaataaaaaacttaaaggcttaccaaaatggtgaagtagattttaaagaagttggtgtcaaagcccttgacgataaaactgttcagtatactttgaacaagcctgaaagctactggaattcaaaaacaacttatagtgtgcttttcccagttaatgcgaaatttttgaagtcaaaaggtaaagattttggtacaaccgatccatcatcaatccttgttaatggtgcttacttcttgagcgccttcacctcaaaatcatctatggaattccataaaaatgaaaactactgggatgctaagaatgttgggatagaatctgttaaattgacttactcagatggttcagacccaggttcgttctacaagaactttgacaagggtgagttcagcgttgcacgactttacccaaatgaccctacctacaaatcagctaagaaaaactatgctgataacattacttacggaatgttgactggagatatccgtcatttaacatggaatttgaaccgtacttctttcaaaaacactaagaaagaccctgcacaacaagatgccggtaagaaagctcttaacaacaaggattttcgtcaagctattcagtttgcttttgaccgagcgtcattccaagcacaaactgcaggtcaagatgccaaaacaaaagccttacgtaacatgcttgtgccaccaacatttgtgaccattggagaaagtgattttggttcagaagttgaaaaggaaatggcaaaacttggtgatgaatggaaagacgttaacttagctgatgctcaagatggtttctataatcctgaaaaagcaaaagctgagtttgcaaaagccaaagaagctttgacagctgaaggtgtaaccttcccagttcaattagattaccctgttgaccaagcaaacgcagcaactgttcaggaagctcagtctttcaaacaatctgttgaagcatctcttggtaaagaaaatgtcattgtcaatgttcttgaaacagaaacatcaactcacgaagcccaaggcttctatgctgagaccccagaacaacaagactacgatatcatttcatcatggtggggaccagactaccaagatccacggacctaccttgacatcatgagtccagtaggtggtggatctgttatccaaaaacttggaatcaaagcaggtcaaaataaggatgttgtggcagctgcaggccttgatacttaccaaactctccttgatgaagcagcagcaattacagacgacaacgatgcgcgctataaagcttacgcaaaagcacaagcctaccttacagatagtgccgtagatattccagttgtggcattgggtggcactccacgagttactaaagccgttccatttagcgggggcttctcttgggcagggtctaaaggtcctctagcatataaaggaatgaaacttcaagacaaacctgtcacagcaaaacaatacgaaaatgcaaaagaaaaatggatgaaagcaaaggctaagtcaaatgcaaaatatgctgagaagttagctgatcacgttgaaaaataa

SEQ ID NO: 929 - DNA, 1971 bp, Streptococcus pyogenes; identical to SEQ ID NO: 703

SEQ ID NO: 930 - protein, 305 aa, Streptococcus pyogenes
MQVKADDRASGETKASNTHDDSLPKPETIQEAKATIDAVEKTLSQQKAELTELATALTKTTAEINHLKEQQDNEQKALTSAQEIYTNTLASSEETLLAQGAEHQRELTATETELHNAQADQHSKETALSEQKASISAETTRAQDLVEQVKTSEQNIAKLNAMISNPDAITKAAQTANDNTKALSSELEKAKADLENQKAKVKKQLTEELAAQKAALAEKEAELSRLKSSAPSTQDSIVGNNTMKAPQGYPLEELKKLEASGYIGSASYNNYYKEHADQIIAKASPGNQLNQYQAAALEHHHHHHH

SEQ ID NO: 931 - protein, 5 aa, Streptococcus pyogenes
  VARIANT (1)...(5): Xaa = Any Amino Acid
LPXTG

SEQ ID NO: 932 - protein, 14 aa, Streptococcus pyogenes
EAAKEEFKKEVEES

SEQ ID NO: 933 - protein, 4 aa, Streptococcus pyogenes
LSEA

SEQ ID NO: 934 - protein, 17 aa, Streptococcus pyogenes
QKETYKQKIKTAPDKDK

SEQ ID NO: 935 - protein, 15 aa, Streptococcus pyogenes
ESTTQPVEAPVQETQ

SEQ ID NO: 936 - protein, 21 aa, Streptococcus pyogenes
SVTTDSPEETPSSESPVAPAL

SEQ ID NO: 937 - protein, 10 aa, Streptococcus pyogenes
QKETYKQKIK

SEQ ID NO: 938 - protein, 14 aa, Streptococcus pyogenes
STTQPVEAPVQETQ

SEQ ID NO: 939 - protein, 18 aa, Streptococcus pyogenes
TDSPEETPSSESPVAPAL

SEQ ID NO: 940 - protein, 19 aa, Streptococcus pyogenes
KETYKQKIKTAPDKDKLLF

SEQ ID NO: 941 - protein, 18 aa, Streptococcus pyogenes
DSPEETPSSESPVAPALS

SEQ ID NO: 942 - protein, 7 aa, Streptococcus pyogenes
KETYKQK

SEQ ID NO: 943 - protein, 15 aa, Streptococcus pyogenes
DSPEETPSSESPVAP

SEQ ID NO: 944 - protein, 16 aa, Streptococcus pyogenes
EETPSSESPVAPALSE

SEQ ID NO: 945 - protein, 7 aa, Streptococcus pyogenes
LSEAPAQ

SEQ ID NO: 946 - protein, 6 aa, Streptococcus pyogenes
SEAPAQ

SEQ ID NO: 947 - protein, 5 aa, Streptococcus pyogenes
EAPAQ

SEQ ID NO: 948 - protein, 10 aa, Streptococcus pyogenes
PAESEEPSVA

SEQ ID NO: 949 - protein, 11 aa, Streptococcus pyogenes
LVTKRQKETKK

SEQ ID NO: 950 - protein, 12 aa, Streptococcus pyogenes
VDGIPPISLTQK

SEQ ID NO: 951 - protein, 13 aa, Streptococcus pyogenes
TATTSENWHHIDK

SEQ ID NO: 952 - protein, 4 aa, Streptococcus pyogenes
LSEA

SEQ ID NO: 953 - protein, 14 aa, Streptococcus pyogenes
DGLIPLGISLEAAK

SEQ ID NO: 954 - protein, 11 aa, Streptococcus pyogenes
EEFKKEVEESR

SEQ ID NO: 955 - protein, 8 aa, Streptococcus pyogenes
QKETYKQK

SEQ ID NO: 956 - protein, 14 aa, Streptococcus pyogenes
LLFTYHSEYMTAVK

SEQ ID NO: 957 - protein, 23 aa, Streptococcus pyogenes
IKTAPDKDKLLFTYHSEYMTAVK

SEQ ID NO: 958 - protein, 29 aa, Streptococcus pyogenes
DSDKPSSAAEKPAASSLVSEQTVQQPTSK

SEQ ID NO: 959 - protein, 30 aa, Streptococcus pyogenes; identical to SEQ ID NO: 383

SEQ ID NO: 960 - protein, 16 aa, Streptococcus pyogenes
SSDKKEEQEQSYSPNR

SEQ ID NO: 961 - protein, 11 aa, Streptococcus pyogenes
EEQEQSYSPNR

SEQ ID NO: 962 - protein, 7 aa, Streptococcus pyogenes
  VARIANT (1)...(7): Xaa = Any Amino Acid
RDLPXTG

SEQ ID NO: 963 - protein, 8 aa, Streptococcus pyogenes
LVPRGSHM

SEQ ID NO: 964 - protein, 11 aa, Streptococcus pyogenes
AAALEHHHHHH

SEQ ID NO: 965 - DNA, 31 bp, Streptococcus pyogenes
gtgcgtcatatgcaagtcaaagcagatgata

SEQ ID NO: 966 - DNA, 39 bp, Streptococcus pyogenes
actcgctagcggccgcttggtattgatttaattgattac

SEQ ID NO: 967 - DNA, 31 bp, Streptococcus pyogenes
gtgcgtcatatggatattccagcagatcgta

SEQ ID NO: 968 - DNA, 35 bp, Streptococcus pyogenes
actcgctagcggccgcgactcctgctttaagagct

SEQ ID NO: 969 - protein, 12 aa, Streptococcus pyogenes
VDGIPPISLTQK

SEQ ID NO: 970 - protein, 23 aa, Streptococcus pyogenes
IKTAPDKDKLLFTYHSEYMTAVK

SEQ ID NO: 971 - protein, 291 aa, Streptococcus pyogenes
MATTVHGETVVNGAKLTVTKNLDLVNSNALIPNTDFTFKIEPDTTVNEDGNKFKGVALNTPMTKVTYTNSDKGGSNTKTAEFDFSEVTFEKPGVYYYKVTEEKIDKVPGVSYDTTSYTVQVHVLWNEEQQKPVATYIVGYKEGSKVPIQFKNSLDSTTLTVKKKVSGTGGDRSKDFNFGLTLKANQYYKASEKVMIEKTTKGGQAPVQTEASIDQLYHFTLKDGESIKVTNLPVGVDYVVTEDDYKSEKYTTNVEVSPQDGAVKNIAGNSTEQETSTDKDMTITFTNKKDF

SEQ ID NO: 972 - DNA, 876 bp, Streptococcus pyogenes
atggctacaacagttcacggggagactgttgtaaacggagccaaactaacagttacaaaaaaccttgatttagttaatagcaatgcattaattccaaatacagattttacatttaaaatcgaacctgatactactgtcaacgaagacggaaataagtttaaaggtgtagctttgaacacaccgatgactaaagtcacttacaccaattcagataaaggtggatcaaatacgaaaactgcagaatttgatttttcagaagttacttttgaaaaaccaggtgtttattattacaaagtaactgaggagaagatagataaagttcctggtgtttcttatgatacaacatcttacactgttcaagttcatgtcttgtggaatgaagagcaacaaaaaccagtagctacttatattgttggttataaagaaggtagtaaggtgccaattcagttcaaaaatagcttagattctactacattaacggtgaagaaaaaagtttcaggtaccggtggagatcgctctaaagattttaattttggtctgactttaaaagcaaatcagtattataaggcgtcagaaaaagtcatgattgagaagacaactaaaggtggtcaagctcctgttcaaacagaggctagtatagatcaactctatcattttaccttgaaagatggtgaatcaatcaaagtcacaaatcttccagtaggtgtggattatgttgtcactgaagacgattacaaatcagaaaaatatacaaccaacgtggaagttagtcctcaagatggagctgtaaaaaatatcgcaggtaattcaactgaacaagagacatctactgataaagatatgaccattacttttacaaataaaaaagacttttga

SEQ ID NO: 973 - protein, 151 aa, Streptococcus pyogenes
MIYSFQNPSEDVLKAYLESAKTIAVVGLSDRKDTAAYGVAKFMQAMDYRIIPVNPKLAGQLILGEKVYASIKAIPFEVDIVDVFRRSEFLPEVARDFLAGQAKVFWAQLGLENQEAQTILRSAGKEAIVMNRCLKIDYLQLVAKPECITNH

SEQ ID NO: 974 - DNA, 456 bp, Streptococcus pyogenes
gtgatttattcgtttcaaaatccctcagaggatgtcctaaaagcttacttggagtcagccaaaaccattgcggttgttggtctttctgaccgcaaagacacagcagcttatggtgtcgccaaatttatgcaggctatggattatcggatcattccagtcaatcccaaattagcaggtcagcttattttgggagagaaggtctatgccagtatcaaggcaattccctttgaggttgacattgtagatgtctttcgcagaagtgagtttttaccagaagttgccagagactttttagcaggtcaggccaaagtcttttgggcgcaattaggccttgaaaaccaagaagcacaaaccattttacggtcggcaggcaaagaggctattgtgatgaaccgctgcctaaaaatagactatttgcaattagtcgctaaaccagaatgcatcacaaatcattga

SEQ ID NO: 975 - protein, 744 aa, Streptococcus pyogenes
MQKRDKTNYGSANNKRRQTTIGLLKVFLTFVALIGIVGFSIRAFGAEEQSVPNKQSSVQDYPWYGYDSYSKGYPDYSPLKTYHNLKVNLDGSKEYQAYCFNLTKHFPSKSDSVRSQWYKKLEGTNENFIKLADKPRIEDGQLQQNILRILYNGYPNDRNGIMKGIDPLNAILVTQNAIWYYTDSSYISDTSKAFQQEETDLKLDSQQLQLMRNALKRLINPKEVESLPNQVPANYQLSIFQSSDKTFQNLLSAEYVPDTPPKPGEEPPAKTEKTSVIIRKYAEGDYSKLLEGATLKLAQIEGSGFQEKIFDSNKSGEKVELPNGTYVLSELKPPQGYGVATPITFKVAAEKVLIKNKEGQFVENQNKEIAEPYSVTAFNDFEEIGYLSDFNNYGKFYYAKNTNGTNQVVYCFNADLHSPPDSYDHGANIDPDVSESKEIKYTHVSGYDLYKYAATPRDKDADFFLKHIKKILDKGYKKKGDTYKTLTEAQFRAATQLAIYYYTDSADLTTLKTYNDNKGYHGFDKLDDATLAVVHELITYAEDVTLPMTQNLDFFVPNSSRYQALIGTQYHPNELIDVISMEDKQAPIIPITHKLTISKTVTGTIADKKKEFNFEIHLKSSDGQAISGTYPTNSGELTVTDGKATFTLKDGESLIVEGLPSGYSYEITETGASDYEVSVNGKNAPDGKATKASVKEDETVAFENRKDLVPPTGLTTDGAIYLWLLLLVPFGLLVWLFGRKGTKK

SEQ ID NO: 976 - protein, 344 aa, Streptococcus pyogenes
MKKNKLLLATAILATALGTASLNQNVKAETAGVSENAKLIVKKTFDSYTDNEVLMPKADYTFKVEADSTASGKTKDGLEIKPGIVNGLTEQIISYTNTDKPDSKVKSTEFDFSKVVFPGIGVYRYTVSEKQGDVEGITYDTKKWTVDVYVGNKEGGGFEPKFIVSKEQGTDVKKPVNFNNSFATTSLKVKKNVSGNTGELQKEFDFTLTLNESTNFKKDQIVSLQKGNEKFEVKIGTPYKFKLKNGESIQLDKLPVGITYKVNEMEANKDGYKTTASLKEGDGQSKMYQLDMEQKTDESADEIVVTNKRDTQVPTGVVGTLAPFAVLSIVAIGGVIYITKRKKA

SEQ ID NO: 977 - protein, 183 aa, Streptococcus pyogenes
MILTMLAFNQTVLAKDSTVQTSISVENVLERAGDSTPFSIALESIDAMKTIEEITIAGSGKASFSPLTFTTVGQYTYRVYQKPSQNKDYQADTTVFDVLVYVTYDEDGTLVAKVISRRAGDEEKSAITFKPKWLVKPIPPRQPNIPKTPLPLAGEVKSLLGILSIVLLGLLVLLYVKKLKSRL

SEQ ID NO: 978 - protein, 656 aa, Streptococcus pyogenes
MSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNSEIPKKDKSKSNTSLPATGEKQHNKFFWMVTSCSLISSVFVISLKSKKRLSSC

SEQ ID NO: 979 - protein, 733 aa, Streptococcus pyogenes
MTQKNSYKLSFLLSLTGFILGLLLVFIGLSGVSVGHAETRNGANKQGAFEIKKNKSQEEYNYEVYDNRNILQDGEHKLEIKRVDGTGKTYQGFCFQLTKNFPTAQGVSKKLYKKLSSSDEETLKQYASKYTSNRRGDTSGNLKKQIAKVLTEGYPTNKSDWLNGLTENEKIEVTQDAIWYFTETTVPADRSYTNRNVNSQKMKEVYQKLIDTTDIDKYEDVQFDLFVPQDTNLQAVISVEPVIESLPWTSLKPIAQKDITAKKIWVDAPKEKPIIYFKLYRQLPGEKEVAVDDAELKQINSEGQQEISVTWTNQLVTDEKGMAYIYSVKEVDKNGELLEPKDYIKKEDGLTVTNTYVKPTSGHYDIEVTFGNGHIDITEDTTPDIVSGENQMKQIEGEDSKPIDEVTENNLIEFGKNTMPGEEDGTNSNKYEEVEDSRPVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTKGSGQVIDIEEKLPDEQGHSGSTTEIEDSKSSDVIIGGQGEVVDTTEDTQSGMTGHSGSTTKIEDSKSSDVIVGGQGQIVETTEDTQTGMHGDSGRKTEVEDTKLVQSFHFDNKEPESNSEIPKKDKSKSNTSLPATGEKQHNKFFWMVTSCSLISSVFVISLKSKKRLSSC

SEQ ID NO: 980 - protein, 627 aa, Streptococcus pyogenes
MVSSYMFVRGEKMNNKIFLNKEASFLAHTKRKRRFAVTLVGVFFMLLACAGAIGFGQVAYAADEKTVPSHSSPNPEFPWYGYDAYGKEYPGYNIWTRYHDLRVNLNGSRSYQVYCFNIQSNYPSQKNSFIKNWFKKIEGNGKSFVDYAHTTKLGKEELEQRLLSLLYNAYPNDANGYMKGLEHLNAITVTQYAVWHYSDNSQYQFETLWESEAKEGKISRSQVTLMREALKKLIDPNLEATAVNKIPSGYRLNIFESENEAYQNLLSAEYVPDDPPKPGETSEHNPKTPELDGTPIPEDPKHPDDNLEPTLPPVMLDGEEVPEVPSESLEPALPPLMPELDGQEVPEKPSIDLPIEVPRYEFNNKDQSPLAGESGETEYITEVYGNQQNPVDIDKKLPNETGFSGNMVETEDTKEPEVLMGGQSESVEFTKDTQTGMSGQTTPQVETEDTKEPEVLMGGQSESVEFTKDTQTGMSGQTTPQIETEDTKEPEVLMGGQSESVEFTKDTQTGMSGQTTPQIETEDTKEPEVLMGGQSESVEFTKDTQTGMSGFSETATVVEDTRPKLVFHFDNNEPKVEENREKPTKNITPILPATGDIENVLAFLGILILSVLSIFSLLKNKQSNKKV

SEQ ID NO: 981 - protein, 1036 aa, Streptococcus pyogenes
MYSRLKRELVIVINRKKKYKLIRLMVTVGLIFSQLVLPIRRLGLQMISTQTKVIPQEIVTQTETQGTQVVATKQKLESENSSLKVALKRESGFEHNATIDASLDTESQGDNSQRSVTQAIVTMALELRKQGLSIVDTKIVRIQSSTNQRNDITTTLTFKNGLSLEGASTEANDPNVRVGIVNPNDTVQTITPTIKQDADGKVKNLVFTGRLGKQVIIVSTTRLKEEQTISLDSYGELVIDGAVGLSQKDRPPYSKPITVNILKPKLSSIESSLDSKDFEIVKTIDNLYTWDDQFYLLDFISKQYEVLKTDYQSAKDSTPQTRDILFGEYTVEPLVMNKGHNNTINIYIRSTRPLGLKPIGAAPALIQPRSFRSLTPRSTRMKRSAPVEKFEGELEHHKRIDYLGDNQNNPDTTIDDKEDEHDTSDLYRLYLDMTGKKNPLDILVVVDKSGSMQEGIGSVQRYRYYAQRWDDYYSQWVYHGTFDYSSYQGESFNRGQIHYRYRGIVSVSDGIRRDDAVKNSLLGVNGLLQRFVNINPENKLSVIGFQGSADYHAGKWYPDQSPRGGFYQPNLNNSRDAELLKGWSTNSLLDPNTLTALHNNGTNYHAALLKAKEILNEVKDDGRRKIMIFISDGVPTFYFGEDGYRSGNGSSNDRNNVTRSQEGSKLAIDEFKARYPNLSIYSLGVSKDINSDTASSSPVVLKYLSGEEHYYGITDTAELEKTLNKIVEDSKLSQLGISDSLSQYVDYYDKQPDVLVTRKSKVNDETEILYQKDQVQEAGKDIIDKVVFTPKTTSQPKGKVTLTFKSDYKVDDEYTYTLSFNVKASDEAYEKYKDNEGRYSEMGDSDTDYGTNQTSSGKGGLPSNSDASVNYMADGREQKLPYKHPVIQVKTVPITFTKVDADNNQKKLAGVEFELRKEDKKIVWEKGTTGSNGQLNFKYLQKGKTYYLYETKAKLGYTLPENPWEVAVANNGDIKVKHPIEGELKSKDGSYMIKNYKIYQLPSSGGRGSQIFIIVGSMTATVALLFYRRQHRKKQY

SEQ ID NO: 982 - protein, 556 aa, Streptococcus pyogenes
MTNRRETVREKILITAKKLMLACLAILAVVGLGMTRVSALSKDDTAQLKITNIEGGPTVTLYKIGEGVYNTNGDSFINFKYAEGVSLTETGPTSQEITTIANGINTGKIKPFSTENVSISNGTATYNARGASVYIALLTGATDGRTYNPILLAASYNGEGNLVTKNIDSKSNYLYGQTSVAKSSLPSITKKVTGTIDDVNKKTTSLGSVLSYSLTFELPSYTKEAVNKTVYVSDNMSEGLTFNFNSLTVEWKGKMANITEDGSVMVENTKIGIAKEVNNGFNLSFIYDSLESISPNISYKAVVNNKAIVGEEGNPNKAEFFYSNNPTKGNTYDNLDKKPDKGNGITSKEDSKIVYTYQIAFRKVDSVSKTPLIGAIFGVYDTSNKLIDIVTTNKNGYAISTQVSSGKYKIKELKAPKGYSLNTETYEITANWVTATVKTSANSKSTTYTSDKNKATDNSEQVGWLKNGIFYSIDSRPTGNDVKEAYIESTKALTDGTTFSKSNEGSGTVLLETDIPNTKLGELPSTGSIGTYLFKAIGSAAMIGAIGIYIVKRRKA

SEQ ID NO: 983 - protein, 698 aa, Streptococcus pyogenes
MVSSYMFARGEKMNNKMFLNKEAGFLVHTKRKRRFAVTLVGVFFLLLACAGAIGFGQVAYAADEKTVPNFKSPDPDYPWYGYDSYRGIFARYHNLKVNLKGSKEYQAYCFNLTKYFPRPTYSTTNNFYKKIDGSGSAFKSYAANPRVLDENLDKLEKNILNVIYNGYKSNANGFMNGIEDLNAILVTQNAIWYYSDSAPLNDVNKMWEREVRNGEISESQVTLMREALKKLIDPNLEATAANKIPSGYRLNIFKSENEDYQNLLSAEYVPDDPPKPGDTSEHNPKTPELDGTPIPEDPKRPDESSEPALPPLMPELDGEEVPEVPSESLEPALPPLMPELDGEEVPEVPSESLEPALPPLMPELDGEEVPEVPSESLEPALPPLMPELDGEEVPEVPSESLEPALPPLMPELDGEEVPEKPSVDLPIEVPRYEFNNKDQSPLAGESGETEYITEVYGNQQNPVDIDKKLPNETGFSGNMVETEDTKEPEVLMGGQSESVEFTKDTQTGMSGQTTPQVETEDTKEPEVLMGGQSESVEFTKDTQTGMSGQTTPQVETEDTKEPGVLMGGQSESVEFTKDTQTGMSGQTTPQVETEDTKEPGVLMGGQSESVEFTKDTQTGMSGFSETVTIVEDTRPKLVFHFDNNEPKVEENREKPTKNITPILPATGDIENVLAFLGILILSVLSIFSLLKNKQNNKV

SEQ ID NO: 984 - protein, 756 aa, Streptococcus pyogenes
MNNKKLQKKQDAPRVSNRKPKQLTVTLVGVFLMFLTLVSSMRGAQSIFGEEKRIEEVSVPKIKSPDDAYPWYGYDSYDSSHPYYERFKVAHDLRVNLNGSKSYQVYCFNINSHYPNRKNAFSKQWFKRVDGTGDVFTNYAQTPKIRGESLNNKLLSIMYNAYPKNANGYMDKIEPLNAILVTQQAVWYYSDSSYGNIKTLWASELKDGKIDFEQVKLMREAYSKLISDDLEETSKNKLPQGSKLNIFVPQDKSVQNLLSAEYVPESPPAPGQSPEPPVQTKKTSVIIRKYAEGDYSKLLEGATLRLTGEDILDFQEKVFQSNGTGEKIELSNGTYTLTETSSPDGYKIAEPIKFRVVNKKVFIVQKDGSQVENPNKEVAEPYSVEAYSDMQDSNYINPETFTPYGKFYYAKNKDKSSQVVYCFNADLHSPPESEDGGGTIDPDISTMKEVKYTHTAGSDLFKYALRPRDTNPEDFLKHIKKVIEKGYNKKGDSYNGLTETQFRAATQLAIYYFTDSTDLKTLKTYNNGKGYHGFESMDEKTLAVTKELINYAQDNSAPQLTNLDFFVPNNSKYQSLIGTEYHPDDLVDVIRMEDKKQEVIPVTHSLTVKKTVVGELGDKTKGFQFELELKDKTGQPIVNTLKTNNQDLVAKDGKYSFNLKHGDTIRIEGLPTGYSYTLKETEAKDYIVTVDNKVSQEAQSASENVTADKEVTFENRKDLVPPTGFITDGGTYLWLLLLVPFGLLVWFFGRKGLKND

SEQ ID NO: 985 - protein, 342 aa, Streptococcus pyogenes
MKKNKLLLATAILATALGTASLNQNVKAETAGVVSSGQLTIKKSITNFNDDTLLMPKTDYTFSVNPDSAATGTESNLPIKPGIAVNNQDIKVSYSNTDKTSGKEKQVVVDFMKVTFPSVGIYRYVVTENKGTAEGVTYDDTKWLVDVYVGNNEKGGLEPKYIVSKKGDSATKEPIQFNNSFETTSLKIEKEVTGNTGDHKKAFTFTLTLQPNEYYEASSVVKIEENGQTKDVKIGEAYKFTLNDSQSVILSKLPVGINYKVEEAEANQGGYTTTATLKDGEKLSTYNLGQEHKTDKTADEIVVTNNRDTQVPTGVVGTLAPFAVLSIVAIGGVIYITKRKKA

SEQ ID NO: 986 - protein, 1161 aa, Streptococcus pyogenes
MTQKNSYKLSFLLSLTGFILGLLLVFIGLSGVSVGHAETRNGANKQGSFEIKKVDQNNKPLPGATFSLTSKDGKGTSVQTFTSNDKGIVDAQNLQPGTYTLKEETAPDGYDKTSRTWTVTVYENGYTKLVENPYNGEIISKAGSKDVSSSLQLENPKMSVVSKYGKTEVSSGAADFYRNHAAYFKMSFELKQKDKSETINPGDTFVLQLDRRLNPKGISQDIPKIIYDSANSPLAIGKYHAENHQLIYTFTDYIAGLDKVQLSAELSLFLENKEVLENTSISNFKSTIGGQEITYKGTVNVLYGNESTKESNYITNGLSNVGGSIESYNTETGEFVWYVYVNPNRTNIPYATMNLWGFGRARSNTSDLENDANTSSAELGEIQVYEVPEGEKLPSSYGVDVTKLTLRTDITAGLGNGFQMTKRQRIDFGNNIQNKAFIIKVTGKTDQSGKPLVVQSNLASFRGASEYAAFTPVGGNVYFQNEIALSPSKGSGSGKSEFTKPSITVANLKRVAQLRFKKMSTDNVPLPEAAFELRSSNGNSQKLEASSNTQGEVHFKDLTSGTYDLYETKAPKGYQQVTEKLATVTVDTTKPAEEMVTWGSPHSSVKVEANKEVTIVNHKETLTFSGKKIWENDRPDQRPAKIQVQLLQNGQKMPNQIQEVTKDNDWSYHFKDLPKYDAKNQEYKYSVEEVNVPDGYKVSYLGNDIFNTRETEFVFEQNNFNLEFGNAEIKGQSGSKIIDEDTLTSFKGKKIWKNDTAENRPQAIQVQLYADGVAVEGQTKFISGSGNEWSFEFKNLKKYNGTGNDIIYSVKEVTVPTGYDVTYSANDIINTKREVITQQGPKLEIEETLPLESGASGGTTTVEDSRPVDTLSGLSSEQGQSGDMTIEEDSATHIKFSKRDIDGKELAGATMELRDSSGKTISTWISDGQVKDFYLMPGKYTFVETAAPDGYEIATAITFTVNEQGQVTVNGKATKGDTHIVMVDAYKPTKGSGQVIDIEEKLPDEQGHSGSTTEIEDSKSSDLIIGGQGEVVDTTEDTQSGMTGHSGSTTEIEDSKSSDVIIGGQGQVVETTEDTQTGMYGDSGCKTEVEDTKLVQSFHFDNKEPESNSEIPKKDKPKSNTSLPATGEKQHNMFFWMVTSCSLISSVFVISLKSKKRLSSC

SEQ ID NO: 987 - DNA, 2235 bp, Streptococcus pyogenes
ttgcaaaagagggataaaaccaattatggaagcgctaacaacaaacgacgacaaacgacgatcggattactgaaagtatttttgacgtttgtagctctgataggaatagtagggttttctatcagagcgttcggagctgaagaacaatcagtgccaaataaacaaagctcagttcaagattatccgtggtatggctatgattcttattctaaaggctacccagactatagtccgttaaagacttaccataatttaaaagtaaatttagatggaagtaaggagtatcaagcatactgctttaatttaacaaaacactttccatccaagtcagatagtgttagatcacaatggtataaaaaacttgaaggaactaatgaaaactttatcaagttagcagataaaccaagaatagaagacggacagttacaacaaaatatattgaggattctctataatggatatcctaatgatcgtaatgggataatgaaagggatagatcctctaaacgctattttagtgactcaaaatgctatttggtactatactgatagttcctatatttctgatactagtaaagcttttcaacaagaagaaacagatcttaaattagattcacagcaactacaactaatgcgtaatgcgctaaaaagattaattaatccaaaagaggtagaaagtttaccgaatcaggttcccgcaaattatcagttaagtatttttcaatcttctgataagactttccaaaatcttttaagtgctgagtatgttccggatactcccccaaaaccaggagaagagcctccggctaaaactgaaaaaacatcagtcattatcagaaaatatgcggaaggtgactactctaaacttctagagggagcaaccttaaagcttgctcaaattgaaggaagtggttttcaggagaaaatttttgatagtaacaagtctggagagaaagtagagctacctaatgggacttacgttttaagtgagctaaaacctcctcaaggatatggagttgccacacccattacttttaaagttgcagctgagaaagttttaataaaaaataaagaaggtcaatttgtagagaaccaaaataaggaaatcgcagagccatattctgtaacagctttcaatgactttgaagagattggttatttatctgattttaataactatggtaagttttactatgcaaaaaatactaatggaactaatcaagttgtctactgtttcaatgctgatttacactcaccacctgactcatatgatcacggagcaaatattgatcctgatgtcagtgaaagtaaagagataaagtatacacatgtttctggctatgatttgtataaatatgcagccacaccaagagacaaagatgctgatttcttcttaaaacatatcaagaaaattcttgataaaggttataagaagaagggggatacctataagacattaactgaagctcagtttagagcagcaacccaattagctatttattactatacagatagtgctgatttaacaacacttaagacatataatgataacaagggttatcatggttttgataaactggatgatgcaacattagctgtagttcatgagttgatcacctatgctgaggatgtcaccttaccaatgactcaaaatctagatttctttgttcctaatagcagtagataccaggcacttattggaacgcagtatcatccaaatgaattgattgatgttatttctatggaagataaacaggctcctattattcctattactcacaagttaactatttctaaaactgttactggaactattgcagataagaaaaaagaatttaactttgaaatacatttaaaatcttctgatggacaagctataagtggaacatatccgacaaactctggagaactcacagttacagatggaaaagctaccttcacattaaaggatggagaatcattgattgttgaggggctaccttcaggttactcttatgaaattacagaaacgggtgcttcagattatgaggtaagtgttaatggaaaaaatgcaccagatggaaaagcgacgaaagcctcagttaaggaagatgagactgtagcttttgaaaaccgaaaagatcttgtcccaccaactggtttgacaacagatggggctatctatctttggttgttattacttgttccatttgggttattggtttggctatttggtcgtaaagggactaaaaaatga

SEQ ID NO: 988 - DNA, 1035 bp, Streptococcus pyogenes
atgaaaaaaaacaaattattacttgctactgcaatcttagcaactgctttaggaacagcttctttaaatcaaaacgtaaaagctgagacggcaggagtgtccgaaaatgcaaaattaatagtaaaaaagacatttgactcttatacagacaatgaagttttaatgccaaaagctgattatacttttaaagtagaggcagatagtacagctagtggcaaaacgaaagacggtttagagattaagccaggtattgttaatggtttaacagaacagattatcagctatactaatactgataaaccagatagtaaagttaaaagtacagagtttgatttttcaaaagtagtattccctggtattggtgtttaccgctatactgtttcagaaaaacaaggtgatgttgaaggaattacctacgatactaagaagtggacagtagatgtttatgttggaaacaaagaaggtggtggttttgaacctaagtttattgtatctaaggaacaaggaacagacgtcaaaaaaccagttaattttaacaactcgtttgcaactacttcgttaaaagttaagaagaatgtatcggggaatactggagaattgcaaaaagaatttgactttacattgacgcttaatgaaagcacgaattttaaaaaagatcaaattgtttctttacaaaaaggaaacgagaaatttgaagttaagattggtactccctacaagtttaaactcaaaaatggggaatctattcaactagacaagttaccagttggtattacttataaagtcaatgaaatggaagctaataaagatgggtataaaacaacagcatccttgaaagagggagatggtcaatctaaaatgtatcaattggatatggaacaaaaaacagacgaatctgctgacgaaatcgttgtcacaaataagcgtgacactcaagttccaactggtgttgtaggcacccttgctccatttgcagttcttagcattgtggctattggtggagttatctatattacaaaacgtaaaaaagcttaa

SEQ ID NO: 989 - DNA, 552 bp, Streptococcus pyogenes
atgatattaaccatgctggcctttaatcagactgttttagcaaaagacagcactgttcaaactagcattagtgtcgaaaatgtcttagagagagcaggcgatagtactccattttcgattgcattagaatcaattgatgcgatgaaaacaatagaagaaataacaattgctggttctgggaaagcaagcttttcccctctgaccttcacaacagttgggcaatatacttatcgtgtttatcagaagccttcacaaaataaagattatcaagcagatactactgtatttgacgttcttgtctatgtgacctatgatgaagatgggactctagtcgcaaaagttatttctcgaagggctggagacgaagaaaaatcagcgattacttttaagcccaaatggttagtaaaaccaataccgcctagacaacctaacatccctaaaaccccattaccattagctggtgaagtaaaaagtttattgggtatcttaagtatcgtattactggggttactagttcttctttatgttaaaaaactaaagagtaggctataa

SEQ ID NO: 990 - DNA, 1971 bp, Streptococcus pyogenes
ttgagtagtagtgatgaagaaacactaaagcaatatgcctctaaatatacaagtaataggagaggagatactagtggtaatcttaaaaagcaaattgctaaggttctgacagaaggttacccaactaacaaaagtgattggttaaatggattgactgaaaacgaaaaaatagaagtaacccaggatgcaatttggtattttacagaaacgacagttccggctgatagaagttatacgaatcgcaacgtaaatagtcaaaaaatgaaagaagtgtatcaaaagctaattgatacaacagatatagataaatatgaagatgtacaatttgatttatttgtgccacaagatacaaacttacaggcagtaattagtgtagagcctgttatcgaaagccttccttggacatcgttgaagccaatagcccagaaggatatcactgcaaaaaaaatctgggtagatgcacctaaagaaaaaccaattatttattttaagctatatagacagctgcctggagaaaaggaagtagcagtggatgacgctgagctaaaacagataaatagtgaaggtcaacaagaaatatcagtaacttggacaaatcaacttgttacagatgaaaaaggaatggcttatatttattctgtaaaagaagtagataaaaatggcgagttacttgagccaaaagattatatcaagaaggaagatggacttacagttactaatacttatgtaaagccaactagtgggcactatgatatagaagtgacatttggaaatggacatattgatattacagaagatactacaccagatattgtttcaggtgaaaaccaaatgaagcaaatagagggagaagatagtaagcctattgatgaagtaacggaaaataatttaattgaatttggtaaaaacacgatgccaggtgaagaagatggcacaaattctaataagtatgaagaagtcgaagactcacgcccagttgataccttatcaggtttatcaagtgagcaaggtcagtccggtgatatgacaattgaagaagatagtgctacccatattaaattctcaaaacgtgatattgacggcaaagagttagctggtgcaactatggagttgcgtgattcatctggtaaaactattagtacatggatttcagatggacaagtgaaagatttctacctgatgccaggaaaatatacatttgtcgaaaccgcagcaccagacggttatgaggtagcaactgctattacctttacagttaatgagcaaggtcaggttactgtaaatggcaaagcaactaaaggtgacgctcatattgtcatggttgatgcttacaagccaactaagggttcaggtcaggttattgatattgaagaaaagcttccagacgagcaaggccattctggctcaactactgaaatagaagacagtaaatcttcagacgttatcattggcggtcaaggtgaagttgttgacacaacagaagacacacaaagtggtatgacaggccattctggctcaactactgaaatagaagacagtaaatcttcagacgttatcattggcggtcaaggtgaagttgttgacacaacagaagacacacaaagtggtatgacaggccattctggctcaactactaaaatagaagatagcaagtcttcagacgttatcgttggtggtcaggggcagattgtcgagacaacagaggatacccaaactggcatgcacggagattctggtcgtaaaacggaagtcgaagatactaaactagtacaatccttccactttgataacaaggaaccagaaagtaactctgagattcctaaaaaagataagtcaaagagtaatactagtttaccagcaactggtgagaagcaacataacaagttcttttggatggttacttcttgctcacttattagtagtgtttttgtaatatcactaaaatccaaaaaacgcctatcatcatgttaa

SEQ ID NO: 991 - DNA, 2202 bp, Streptococcus pyogenes
atgacacaaaaaaatagctataagttaagcttcctgttatccctaacaggatttattttaggtttattattggtttttataggattgtccggagtatcagtaggacatgcggaaacaagaaatggagcaaacaaacaaggagcttttgaaatcaagaaaaataaaagtcaagaagaatataattatgaagtttatgataacagaaacatacttcaggatggggaacataaacttgaaataaaaagagttgatgggacaggtaaaacttatcaaggtttttgctttcagttaacgaaaaattttcccactgctcaaggtgtaagtaaaaagctgtataaaaaattgagtagtagtgatgaagaaacactaaagcaatatgcctctaaatatacaagtaataggagaggagatactagtggtaatcttaaaaagcaaattgctaaggttctgacagaaggttacccaactaacaaaagtgattggttaaatggattgactgaaaacgaaaaaatagaagtaacccaggatgcaatttggtattttacagaaacgacagttccggctgatagaagttatacgaatcgcaacgtaaatagtcaaaaaatgaaagaagtgtatcaaaagctaattgatacaacagatatagataaatatgaagatgtacaatttgatttatttgtgccacaagatacaaacttacaggcagtaattagtgtagagcctgttatcgaaagccttccttggacatcgttgaagccaatagcccagaaggatatcactgcaaaaaaaatctgggtagatgcacctaaagaaaaaccaattatttattttaagctatatagacagctgcctggagaaaaggaagtagcagtggatgacgctgagctaaaacagataaatagtgaaggtcaacaagaaatatcagtaacttggacaaatcaacttgttacagatgaaaaaggaatggcttatatttattctgtaaaagaagtagataaaaatggcgagttacttgagccaaaagattatatcaagaaggaagatggacttacagttactaatacttatgtaaagccaactagtgggcactatgatatagaagtgacatttggaaatggacatattgatattacagaagatactacaccagatattgtttcaggtgaaaaccaaatgaagcaaatagagggagaagatagtaagcctattgatgaagtaacggaaaataatttaattgaatttggtaaaaacacgatgccaggtgaagaagatggcacaaattctaataagtatgaagaagtcgaagactcacgcccagttgataccttatcaggtttatcaagtgagcaaggtcagtccggtgatatgacaattgaagaagatagtgctacccatattaaattctcaaaacgtgatattgacggcaaagagttagctggtgcaactatggagttgcgtgattcatctggtaaaactattagtacatggatttcagatggacaagtgaaagatttctacctgatgccaggaaaatatacatttgtcgaaaccgcagcaccagacggttatgaggtagcaactgctattacctttacagttaatgagcaaggtcaggttactgtaaatggcaaagcaactaaaggtgacgctcatattgtcatggttgatgcttacaagccaactaagggttcaggtcaggttattgatattgaagaaaagcttccagacgagcaaggccattctggctcaactactgaaatagaagacagtaaatcttcagacgttatcattggcggtcaaggtgaagttgttgacacaacagaagacacacaaagtggtatgacaggccattctggctcaactactaaaatagaagatagcaagtcttcagacgttatcgttggtggtcaggggcagattgtcgagacaacagaggatacccaaactggcatgcacggagattctggtcgtaaaacggaagtcgaagatactaaactagtacaatccttccactttgataacaaggaaccagaaagtaactctgagattcctaaaaaagataagtcaaagagtaatactagtttaccagcaactggtgagaagcaacataacaagttcttttggatggttacttcttgctcacttattagtagtgtttttgtaatatcactaaaatccaaaaaacgcctatcatcatgttaa

SEQ ID NO: 992 - DNA, 1884 bp, Streptococcus pyogenes
gtggtaagctcatatatgtttgtgagaggagagaaaatgaataacaaaatatttttgaataaagaagccagttttttggcacacacaaaaagaaaaaggcgatttgctgtcactttagtgggagtcttttttatgcttttggcatgcgcgggtgctatcggttttggtcaagtagcctatgctgccgatgagaagactgtgccgagtcatagtagtccaaatcctgagtttccttggtacggttatgatgcttatggtaaggaatatcctggatataatatttggactcgttatcatgacttgagagtaaatttaaatgggagtcggagctaccaagtttattgttttaatattcaatctaattatcctagccaaaaaaatagtttcataaaaaattggtttaaaaaaattgagggaaatggcaaatcctttgtagattatgctcacactactaaactaggtaaagaagagttggagcagaggctcttaagtttactgtataatgcgtatcccaacgatgctaatggttatatgaaaggactggagcatttaaatgctattactgtaacacaatatgcagtttggcattactcagataattcacaatatcaatttgagacattatgggagtctgaggcgaaagaaggtaagattagtaggtcacaagttactttaatgcgtgaggcattgaaaaaactaattgatcccaatttagaagctactgcagttaataaaatcccatcaggctatcgtttaaatatctttgagtctgaaaatgaagcttaccaaaatcttttaagtgctgaatatgtacctgatgatccccctaaacctggtgagacgtcagaacataatcctaaaactcccgagttggatggcactccaattcccgaggacccaaaacatccagatgataatttagaacctacattgccgccagtgatgctagatggtgaagaagtcccagaagttccaagcgagagcttagagcctgcgcttcccccattaatgccagagttagatggtcaagaagtccctgaaaaacctagtattgacttacctattgaagttcctcgttatgagtttaacaataaagaccaatcacctctagcgggtgagtctggtgagacggagtatattaccgaagtctatggaaatcaacagaaccctgttgatattgataaaaaacttccgaatgaaacaggtttttcaggaaatatggttgagacagaagatacgaaagagccagaagtgttgatgggaggccaaagtgagtctgttgaatttactaaagacactcaaacaggcatgagtggtcaaacaactcctcaggttgagacagaagatacgaaagagccagaagtgttgatgggaggtcaaagtgagtctgttgaatttactaaagatactcaaacaggcatgagtggtcaaacaactcctcagattgagacagaagacacgaaagagccagaagtgttgatgggaggtcaaagtgagtctgttgaatttactaaagatactcaaacaggcatgagtggtcaaacaactcctcagattgagacagaagacacgaaagagccagaagtgttgatgggaggtcaaagtgagtctgttgaatttactaaagacactcaaacaggcatgagtggtttcagtgaaacggcgactgttgttgaagatacgcgtccgaagttagtgttccattttgacaataatgagcccaaagtggaagagaatcgggaaaagcctacaaaaaatataacacctatccttcctgcaacaggagatattgagaatgttttggcctttcttggaatccttattttgtcagtactttctatttttagccttttaaaaaacaaacaaagcaataaaaaagtctga

SEQ ID NO: 993 - DNA, 3111 bp, Streptococcus pyogenes
atgtacagtagattgaagagagagttagttatagtgataaacagaaaaaagaaatataaactaattagactgatggttaccgtaggccttattttttcgcagttagttttacctataaggcgactaggcttgcagatgatttctacacagaccaaagtgatcccccaagagattgttactcaaacagaaactcagggaactcaggtagttgcaacgaaacaaaaattagagtcagaaaatagtagtctaaaggtagctcttaaaagagaatcaggttttgaacataatgccacgattgatgcttctttagatacagaatcccaaggagataatagtcaacgtagcgtaactcaagctatcgttactatggcattagaattgagaaagcaagggctatcaatcgttgataccaaaatagttagaatccagtcttctaccaatcaaagaaacgatatcacaacaaccttaacttttaagaatggcttatctttagaaggtgcttcaaccgaagcaaacgacccgaatgtaagagtaggtatcgtaaatcctaatgatactgttcaaacaataacacctactattaaacaagacgcagatggtaaagttaagaaccttgtttttactggcaggcttgggaaacaggtcataatagttagcacaactcgtctaaaagaagaacaaacgatctcattagattcttatggagaattagttattgatggagctgttgggctcagccagaaagataggcccccttacagcaagccaatcacagtaaatatcttaaaaccaaagttatcctcaattgaaagttcgcttgattctaaagattttgaaatcgttaaaacgattgataatctctacacttgggacgatcagttttatctcttggattttatttccaaacaatacgaagttttaaaaacggactaccaatcagctaaggatagcaccccacaaacacgagacattttatttggagaatacactgttgagcctttagtcatgaataaaggccataacaatacaattaacatttacattcgttcaacaaggccacttgggttaaaaccaataggagcagccccagcactaattcagccacgttcttttcgctccttaactcccagatcaactagaatgaagaggtctgccccagttgagaaattcgaaggtgaattggagcaccataagcggattgactatttaggagataatcaaaataatcctgataccaccatcgacgataaagaagacgaacatgacacctctgatctctatcgtctctatctggatatgacaggaaagaaaaatcccctagatattcttgttgttgtggataagtcagggagtatgcaggaagggataggatcggttcaaagatatagatactatgctcagagatgggatgattactatagtcaatgggtttatcatggaacttttgactattctagctatcaaggtgagtcttttaacagaggtcaaattcattatagatatagaggtattgtatctgtatctgatggtattagaagagatgatgcggtaaaaaattctcttctaggcgtaaatggattgttgcagagatttgttaatattaatccagaaaataaattatcagttattggctttcaaggcagtgctgattaccatgcaggaaaatggtatcctgatcaatccccacgtggtggattttatcagcctaatttaaataatagtagagatgctgaacttcttaagggatggtctactaattctttattagatcctaatactttgacagcattgcataacaatggtaccaattatcatgctgctttattaaaagctaaagagattctaaatgaagtaaaagatgatggccgaagaaaaataatgatattcataagtgatggagttcccacgttttattttggagaagatggctatcgctcaggaaatggtagttcaaatgatcgtaataatgttacacgatcacaagaaggaagcaaacttgcaatagatgagtttaaggctagatatcctaacttgtcaatatattcattgggcgtttctaaagatattaatagtgatacggcaagttccagtcctgttgtcctaaaatacttgtcaggtgaggagcattactacggtattacggacacagcagaattagaaaaaactttgaataaaattgttgaggatagtaagttatctcagctaggaatttcggatagtttaagtcagtatgttgactactatgataaacaacctgatgtacttgttactagaaaatcgaaggttaatgatgaaacagagattttataccaaaaagaccaagttcaagaagctggtaaagatatcattgataaagttgtatttaccccgaaaactactagtcaaccaaaaggtaaagttactttaacctttaagtctgattataaggttgatgatgaatatacctatacgctttcttttaatgtgaaagcttcagatgaagcctatgagaagtataaggataacgaaggaagatatagcgaaatgggagattccgatactgattatggaaccaaccaaactagttctggaaaaggtggtttgccttctaattcagatgcttcggttaattatatggcagatggtcgtgaacagaaattaccttataagcacccagtgattcaggtcaaaacagtaccaatcacgtttaccaaagtagatgctgacaacaaccagaaaaaacttgcaggtgttgagtttgaactccgtaaagaggacaagaagatcgtctgggaaaagggaacaacaggttcaaatggccaactcaactttaagtaccttcaaaaaggcaaaacctattatctgtatgagacgaaggcaaaacttggatacactcttccagaaaatccatgggaagttgccgttgctaacaacggtgatataaaagtaaaacacccgattgaaggtgaattgaagtcaaaagatggctcttacatgattaaaaattataagatttatcagttgccatcgtctgggggaagaggaagtcaaattttcattatagttggtagcatgacagcaactgtagcattattattttatagacgccaacacaggaaaaagcaatattaa

SEQ ID NO: 994 - DNA, 1671 bp, Streptococcus pyogenes
ttgacaaacaggagagaaacagtgagagagaagatattaataacagcaaaaaaactaatgctagcttgtttagctatcttagcggtagtagggcttggaatgacaagagtatcagctttatcaaaagatgatactgcacaactaaagataacaaatattgaaggtgggccaacagtaacactttataaaataggagaaggtgtttacaacactaatggtgattcttttattaactttaaatatgctgagggggtttctttaactgaaacaggacctacatcacaagaaattactactattgcaaatggtattaatacgggtaaaataaagccttttagtactgaaaacgttagtatttctaatggaacagcaacttataatgcgagaggtgcatctgtttatattgcattattaacaggtgcgacagatggccgtacctacaatcctattttattagctgcatcttataatggtgagggaaatttagttactaaaaatattgattccaaatctaattatttatatggacaaacaagtgttgcaaaatcatcattaccatctattacaaagaaagtaaccgggacaatagatgacgtgaataaaaagactacctcgttaggaagtgtattgtcttattcgctgacatttgaattaccaagttataccaaagaagcagtcaataaaacagtatatgtttctgataatatgtcggaaggtcttacttttaactttaatagtcttacagtagaatggaaaggtaagatggctaatattactgaagatggttcagtaatggtagaaaatacaaaaatcggaatagctaaggaggttaataacggttttaatttaagttttatttatgatagtttagaatctatatcaccaaatataagttataaagctgttgtaaacaataaagctattgttggtgaagagggtaatcctaataaagctgaattcttctattcaaataatccaacaaaaggtaatacatacgataatttagataagaagcctgataaagggaatggtattacatccaaagaagattctaaaattgtttatacttatcaaatagcgtttagaaaagttgatagtgttagtaagaccccacttattggtgcaatttttggagtttatgatactagtaataaattaattgatattgttacaaccaataaaaatggatatgctatttcaacacaagtatcttcaggaaaatataaaattaaggaattaaaagctcctaaaggttattcattgaatacagaaacttatgaaattacggcaaattgggtaactgctacagtcaagacaagtgctaattcaaaaagtactacttatacatctgataaaaataaggcgacagataattcagagcaagtaggatggttaaaaaatggtatattctattctatagatagtagacctacaggaaatgatgttaaagaggcttatattgaatctactaaggctttaactgatggaacaactttctcaaaatcgaatgaaggttcaggtacagtattattagaaactgacatccctaacaccaagctaggtgaattaccttcgacaggtagcattggtacttacctctttaaagctattggttcggctgctatgattggtgcaattggtatttatattgttaaacgtcgtaaagcttaa

SEQ ID NO: 995 - DNA, 2097 bp, Streptococcus pyogenes
atggtaagctcatatatgtttgcgagaggagagaaaatgaataacaaaatgtttttgaacaaagaagccggttttttggtacacacaaaaagaaaaaggcgatttgctgtcactttagtgggagtcttttttctgcttttggcatgtgcgggtgctatcggttttggtcaagtagcctatgctgcggatgagaagactgtgccgaattttaaaagcccagatccagattatccctggtatggttatgattcgtatagaggaatatttgcaagatatcacaatttaaaagtaaatctaaaaggaagtaaggagtatcaagcgtattgttttaacctaacaaaatactttcctcgccccacttatagtactacaaataatttttacaagaaaattgatgggagtggatcagcgttcaaatcttatgcagcgaatcctagggttttagatgagaatttagataaattagaaaaaaatatactgaatgtaatttataatggatataaaagtaatgcaaatggttttatgaatggtatagaagatcttaatgctatactagtaactcaaaacgctatttggtactattcagatagtgctccattaaatgatgttaataaaatgtgggaaagagaggttcggaatggggagattagtgagtcacaagttactttaatgcgtgaggcattgaaaaaactaattgatcccaatttagaagctactgcagctaataaaatcccatcaggatatcgtttaaatatctttaagtctgaaaatgaagattaccaaaatcttttaagtgctgaatatgtacctgatgatccccctaaacctggtgatacgtcagaacataatcctaaaactcccgagttggatggcactccaattcccgaggacccaaaacgtccagatgagagttcagaacctgcgcttcccccattaatgccagagctagatggtgaagaagtcccagaagttccaagcgagagcttagaacctgcgcttcccccattgatgccagagctagatggtgaagaagtcccagaagttccaagcgagagcttagaacctgcgcttcccccattgatgccagagctagatggtgaagaagtcccagaagttccaagcgagagcttagaacctgcgcttcccccattaatgccagagctagatggtgaagaagtcccagaagttccaagcgagagcttagaacctgcgcttcccccattgatgccagagttagatggtgaagaagtccctgaaaaacctagtgttgacttacctattgaagttcctcgttatgagtttaacaataaagaccagtcacctctagcgggtgagtctggtgagacggagtatattaccgaagtctatggaaatcaacagaaccctgttgatattgataaaaaacttccgaatgaaacaggtttttcaggaaatatggttgagacagaagatacgaaagagccagaagtgttgatgggaggtcaaagtgagtctgttgaatttactaaagacactcaaacaggcatgagtggtcaaacaactcctcaggttgagacagaagatacgaaagagccagaagtgttgatgggaggtcaaagtgagtctgttgaatttactaaagacactcaaacaggcatgagtggtcaaacaactcctcaggttgagacagaagatacgaaagagccaggagtgttgatgggaggccaaagtgagtctgttgaatttactaaagacactcaaacaggcatgagtggtcaaacaactcctcaggttgagacagaagacacgaaagagccaggagtgttgatgggaggtcaaagtgagtctgttgaatttactaaagacactcaaacaggcatgagcggtttcagtgaaacagtgaccattgttgaagatacgcgtccgaagttagtgttccattttgacaataatgagcccaaagtggaagagaatcgggaaaagcctacaaaaaatataacacctatccttcctgcaacaggagatattgagaatgttttggcctttcttggaatccttattttgtcagtactttctatttttagccttttaaaaaacaaacaaaacaataaagtctga

SEQ ID NO: 996 - DNA, 2271 bp, Streptococcus pyogenes
atgaataacaaaaaattgcaaaagaagcaagatgctcctcgggtatcaaacagaaagccaaaacaattaactgtcactttagtgggagtatttttaatgtttttgaccttggtaagttccatgagaggtgctcaaagcatatttggagaggaaaagagaattgaagaagtcagtgttcctaaaataaaaagtccagatgatgcctacccttggtatggctatgattcatatgactctagtcatccttactatgaacgttttaaagtagcacatgatttaagggttaatttaaatggaagtaagagctaccaagtatattgctttaatatcaattctcattatccgaatagaaaaaatgctttttctaaacaatggtttaagagagttgatgggacaggtgatgtgttcacaaattatgctcagacacctaagattcgtggagaatcattgaataataaacttttaagtattatgtacaacgcttatcctaaaaatgctaatggctatatggataagatagaaccattaaatgctattttagtaactcaacaagctgtttggtactattctgacagttcttatggtaatataaaaacgttatgggcatctgagcttaaagacggaaaaatagattttgaacaagtaaaattaatgcgtgaagcttactcaaaactaattagtgatgatttagaagaaacatctaaaaataagctacctcaaggatctaaactgaatatttttgttccgcaagataaatctgttcaaaatttattaagtgcagagtacgtgcctgaatcccctccggcaccaggtcagtctccagaaccgccagtgcaaacaaaaaaaacatcagtcattatcagaaaatatgcggaaggtgactactctaaacttctagagggagcaactttgcgtttaacaggggaagatatcctagattttcaagaaaaagtcttccaaagtaatggaacaggagaaaagattgaattatcaaatgggacttataccttaacagaaacatcatctccagatggatataaaattgcggagccgattaagtttagagtagtgaataaaaaagtatttatcgtccaaaaagatggttctcaagtggaaaatccaaacaaagaagtagcagagccatactcagtggaagcgtacagcgatatgcaagatagtaactatattaatccagaaacgttcactccttatgggaaattttattacgctaaaaataaggataaaagttcacaagttgtctactgttttaatgctgatttacactctccacctgaatcagaggatgggggaggaactatagatcctgatattagtacgatgaaagaagtcaagtacacacatacggcaggtagtgatttgtttaaatacgcgctaagaccgagagatacaaatccagaagacttcttaaagcacattaaaaaagtaattgaaaaaggctacaataaaaaaggtgatagctataatggattaacagaaacacagtttcgcgcggctactcagcttgctatctattactttacagacagcactgacttaaaaaccttaaaaacttataacaatgggaaaggttaccatggatttgaatctatggatgaaaaaaccctagctgtaacaaaagaattaattaattacgctcaagataatagtgcccctcaactaacaaatcttgatttcttcgtacctaataatagcaaataccaatctcttattgggacagaataccatccagatgatttggttgacgtgattcgtatggaagataaaaagcaagaagttattccagtaactcacagtttgacagtgaaaaaaacagtagtcggtgagttgggagataaaactaaaggcttccaatttgaacttgagttgaaagataaaactggacagcctattgttaacactctaaaaactaataatcaagatttagtagctaaagatgggaaatattcatttaatctaaagcatggtgacaccataagaatagaaggattaccgacgggatattcttatactctgaaagagactgaagctaaggattatatagtaaccgttgataacaaagttagtcaagaagctcaatcagcaagtgagaatgtcacagcagacaaagaagtcacttttgaaaaccgtaaagatcttgtcccaccaactggttttattactgatggtggaacctatctgtggttattattgcttgtcccatttggtttgttagtgtggttctttggtcgtaaaggactaaaaaatgactaa

SEQ ID NO: 997 - DNA, 1029 bp, Streptococcus pyogenes
atgaaaaaaaataaattattacttgctactgcaatcttagcaactgctttaggaacagcttctttaaatcaaaacgtaaaagctgagacggcaggggttgttagcagtggtcaattaacaataaaaaaatcaattacaaattttaatgatgatacacttttgatgcctaagacagactatacttttagcgttaatccggatagtgcggctacaggtactgaaagtaatttaccaattaaaccaggtattgctgttaacaatcaagatattaaggtttcttattctaatactgataagacatcaggtaaagaaaaacaagttgttgttgactttatgaaagttacttttcctagcgttggtatttaccgttatgttgttaccgagaataaagggacagcagaaggagttacatatgatgatacaaaatggttagttgacgtctatgttggtaataatgaaaagggaggtcttgaaccaaagtatattgtatctaaaaaaggagattctgctactaaagaaccaatccagtttaataattcattcgaaacaacgtcattaaaaattgaaaaggaagttactggtaatacaggagatcataaaaaagcatttacctttacattaacattgcaaccaaatgaatactatgaggcaagttcggttgtgaaaattgaagagaacggacaaacgaaagatgtgaaaattggggaggcatataagtttactttgaacgatagtcagagtgtgatattgtctaaattaccagttggtattaattataaagttgaagaagcagaagctaatcaaggtggatatactacaacagcaactttaaaagatggagaaaagttatctacttataacttaggtcaggaacataaaacagacaagactgctgatgaaatcgttgtcacaaataaccgtgacactcaagttccaactggtgttgtaggcacccttgctccatttgcagttcttagcattgtggctattggtggagttatctatattacaaaacgtaaaaaagcttaa

SEQ ID NO: 998 - DNA, 3486 bp, Streptococcus pyogenes
atgacacaaaaaaatagctataagttaagcttcctgttatccctaacaggatttattttaggtttattattggtttttataggattgtccggagtatcagtaggacatgcggaaacaagaaatggagcaaacaaacaaggatcttttgaaatcaagaaagtcgaccaaaacaataagcctttaccgggagcaactttttcactgacatcaaaggatggcaagggaacatctgttcaaacgttcacttcaaatgataaaggtattgtagatgctcaaaatctccaaccagggacttataccttaaaagaagaaacagcaccagatggttatgataaaaccagccggacttggacagtgactgtttatgagaacggctataccaagttggttgaaaatccctataatggggaaatcatcagtaaagcagggtcaaaagatgttagtagttctttacagttggaaaatcccaaaatgtcagttgtttctaaatatgggaaaacagaggttagtagtggcgcagcggatttctaccgcaaccatgccgcctattttaaaatgtcttttgagttgaaacaaaaggataaatctgaaacaatcaacccaggtgatacctttgtgttacagctggatagacgtctcaatcctaaaggtatcagtcaagatatccctaaaatcatttacgacagtgcaaatagtccgcttgcgattggaaaataccatgctgagaaccatcaacttatctatactttcacagattatattgcgggtttagataaagtccagttgtctgcagaattgagcttattcctagagaataaggaagtgttggaaaatactagtatctcaaattttaagagtaccataggtgggcaggagatcacctataaaggaacggttaatgttctttatggaaatgagagcactaaagaaagcaattatattactaatggattgagcaatgtgggtgggagtattgaaagctacaacaccgaaacgggagaatttgtctggtatgtttatgtcaatccaaaccgtaccaatattccttatgcgaccatgaatttatggggatttggaagggctcgttcaaatacaagcgacttagaaaacgacgctaatacaagtagtgctgagcttggagagattcaggtctatgaagtacctgaaggagaaaaattaccatcaagttatggggttgatgttacaaaacttactttaagaacggatatcacagcaggcctaggaaatggttttcaaatgaccaaacgtcagcgaattgactttggaaataatatccaaaataaagcatttatcatcaaagtaacagggaaaacagaccaatctggtaagccattggttgttcaatccaatttggcaagttttcgtggtgcttctgaatatgctgcttttactccagttggaggaaatgtctacttccaaaacgaaattgccttgtctccttctaagggtagtggttctgggaaaagtgaatttactaagccctctattacagtagcaaatctaaaacgagtggctcagcttcgctttaagaaaatgtcaactgacaatgtgccattgccagaagcggcttttgagctgcgttcatcaaatggtaatagtcagaaattagaagccagttcaaacacacaaggagaggttcactttaaggacctgacctcgggcacatatgacctgtatgaaacaaaagcgccaaaaggttatcagcaggtgacagagaaattggcgaccgttactgttgatactaccaaacctgctgaggaaatggtcacttggggaagcccacattcgtctgtaaaagtagaagctaacaaagaagtcacgattgtcaaccataaagaaacccttacgttttcagggaagaaaatttgggagaatgacagaccagatcaacgcccagcaaagattcaagtgcaactgttgcaaaatggtcaaaagatgcctaaccagattcaagaagtaacgaaggataacgattggtcttatcacttcaaagacttgcctaagtacgatgccaagaatcaggagtataagtactcagttgaagaagtaaatgttccagacggctacaaggtgtcgtatttaggaaatgatatatttaacaccagagaaacagaatttgtgtttgaacagaataactttaaccttgaatttggaaatgctgaaataaaaggtcaatctgggtcaaaaatcattgatgaagacacgctaacgtctttcaaaggtaagaaaatttggaaaaatgatacggcagaaaatcgtccccaagccattcaagtgcagctttatgctgatggagtggctgtggaaggtcaaaccaaatttatttctggctcaggtaatgagtggtcatttgagtttaaaaacttgaagaagtataatggaacaggtaatgacatcatttactcagttaaagaagtaactgttccaacaggttatgatgtgacttactcagctaatgatattattaataccaaacgtgaggttattacacaacaaggaccgaaactagagattgaagaaacgcttccgctagaatcaggtgcttcaggcggtaccactactgtcgaagactcacgcccagttgataccttatcaggtttatcaagtgagcaaggtcagtccggtgatatgacaattgaagaagatagtgctacccatattaaattctcaaaacgtgatattgacggcaaagagttagctggtgcaactatggagttgcgtgattcatctggtaaaactattagtacatggatttcagatggacaagtgaaagatttctacctgatgccaggaaaatatacatttgtcgaaaccgcagcaccagacggttatgagatagcaactgctattacctttacagttaatgagcaaggtcaggttactgtaaatggcaaagcaactaaaggtgacactcatattgtcatggttgatgcttacaagccaactaagggttcaggtcaggttattgatattgaagaaaagcttccagacgagcaaggtcattctggttcaactactgaaatagaagacagtaaatcttcagaccttatcattggcggtcaaggtgaagttgttgacacaacagaagacacacaaagtggtatgacgggccattctggctcaactactgaaatagaagatagcaagtcttcagacgttatcattggtggtcaggggcaggttgtcgagacaacagaggatacccaaactggcatgtacggggattctggttgtaaaacggaagtcgaagatactaaactagtacaatccttccactttgataacaaggaaccagaaagtaactctgagattcctaaaaaagataagccaaagagtaatactagtttaccagcaactggtgagaagcaacataatatgttcttttggatggttacttcttgctcacttattagtagtgtttttgtaatatcactaaaatccaaaaaacgcctatcatcatgttaa

The invention claimed is:

1. A composition comprising:
   a first purified *S. pyogenes* (GAS) polypeptide antigen comprising the amino acid sequence of SEQ ID NO: 296; and
   a second purified GAS polypeptide antigen comprising amino acid 58 through amino acid 261 of SEQ ID NO: 17.

2. A kit comprising:
   a container comprising the composition of claim 1; and
   instructions for a method of inducing immunity against *Streptococcus pyogenes* comprising administering to an individual an effective amount of the composition.

3. A method of inducing immunity against *Streptococcus pyogenes* comprising administering to an individual an effective amount of the composition of claim 1.

* * * * *